(12) United States Patent
Bibillo et al.

(10) Patent No.: US 10,954,557 B2
(45) Date of Patent: *Mar. 23, 2021

(54) METHODS FOR PROCESSING NUCLEIC ACID SAMPLES

(71) Applicant: Bio-Rad Laboratories, Inc., Hercules, CA (US)

(72) Inventors: Arkadiusz Bibillo, Cupertino, CA (US); Pranav Patel, Freemont, CA (US)

(73) Assignee: Bio-Rad Laboratories, Inc., Hercules, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/168,002

(22) Filed: Oct. 23, 2018

(65) Prior Publication Data

US 2019/0040453 A1 Feb. 7, 2019

Related U.S. Application Data

(63) Continuation of application No. PCT/US2017/061197, filed on Nov. 10, 2017.

(60) Provisional application No. 62/477,211, filed on Mar. 27, 2017, provisional application No. 62/421,028, filed on Nov. 11, 2016.

(51) Int. Cl.
| | |
|---|---|
| *C12Q 1/686* | (2018.01) |
| *C12N 9/12* | (2006.01) |
| *C12Q 1/6844* | (2018.01) |
| *C12N 15/10* | (2006.01) |
| *C12Q 1/68* | (2018.01) |
| *C12P 19/34* | (2006.01) |
| *C12Q 1/6806* | (2018.01) |

(52) U.S. Cl.
CPC ........... *C12Q 1/686* (2013.01); *C12N 9/1276* (2013.01); *C12N 15/1096* (2013.01); *C12P 19/34* (2013.01); *C12Q 1/68* (2013.01); *C12Q 1/6806* (2013.01); *C12Q 1/6846* (2013.01); *C12Q 2600/112* (2013.01); *C12Q 2600/118* (2013.01); *C12Q 2600/158* (2013.01); *C12Q 2600/16* (2013.01); *C12Q 2600/178* (2013.01); *C12Y 207/07049* (2013.01)

(58) Field of Classification Search
CPC ........ C12Q 1/686; C12Q 1/6846; C12Q 1/68; C12Q 1/6806; C12N 9/1276; C12N 15/6846; C12P 19/34

See application file for complete search history.

(56) References Cited

U.S. PATENT DOCUMENTS

| | | |
|---|---|---|
| 4,663,290 A | 5/1987 | Weis et al. |
| 4,889,818 A | 12/1989 | Gelfand et al. |
| 4,965,188 A | 10/1990 | Mullis et al. |
| 5,374,553 A | 12/1994 | Gelfand et al. |
| 5,605,793 A | 2/1997 | Stemmer et al. |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 6,444,468 B1 | 9/2002 | Stemmer et al. |
| 7,153,672 B1 | 12/2006 | Eickbush et al. |
| 7,229,765 B2 | 6/2007 | Ziman et al. |
| 7,910,354 B2 | 3/2011 | Drmanac et al. |
| 8,518,640 B2 | 8/2013 | Drmanac et al. |
| 9,228,228 B2 | 1/2016 | Drmanac et al. |
| 9,328,382 B2 | 5/2016 | Drmanac et al. |
| 9,410,173 B2 | 8/2016 | Betts et al. |
| 9,546,389 B2 | 1/2017 | Li et al. |
| 9,617,581 B2 | 4/2017 | Keene et al. |
| 9,708,654 B2 | 7/2017 | Hunicke-Smith et al. |
| 10,023,910 B2 | 7/2018 | Drmanac et al. |
| 10,058,839 B2 | 8/2018 | Fan et al. |
| 2004/0081978 A1 | 4/2004 | Ziman et al. |
| 2004/0137588 A1 | 7/2004 | Scrofani et al. |
| 2006/0281079 A1 | 12/2006 | Eickbush et al. |
| 2007/0111944 A1 | 5/2007 | Scrofani et al. |
| 2007/0255053 A1 | 11/2007 | Ziman et al. |
| 2008/0268508 A1 | 10/2008 | Sowlay et al. |
| 2008/0318796 A1 | 12/2008 | Drmanac et al. |
| 2010/0267573 A1 | 10/2010 | Keene et al. |
| 2010/0297728 A1 | 11/2010 | Ziman et al. |
| 2012/0208199 A1 | 8/2012 | Ziman et al. |
| 2013/0344491 A1 | 12/2013 | Ziman et al. |
| 2014/0040500 A1 | 2/2014 | Zheng et al. |
| 2014/0147851 A1 | 5/2014 | Qian et al. |

(Continued)

FOREIGN PATENT DOCUMENTS

| | | |
|---|---|---|
| EP | 2820158 A1 | 1/2015 |
| WO | WO-9610640 A1 | 4/1996 |

(Continued)

OTHER PUBLICATIONS

See Ngo et al. in the Protein Folding Problem and Tertiary Structure Prediction, 1994, Merz et al. (ed.), Birkhauser, Boston, MA, pp. 433 and 492-495.*

AB076841: Bombyx mori non-LTR retrotransposon R2Bm gene for reverse transcriptase, complete cds and 28S rRNA, GenBank, Jan. 18, 2011 (Jan. 18, 2011), GenBank Accession No. AB076841, National Center for Biotechnology Information, pp. 1-5. Retrieved from the Internet:< on Jan. 25, 2018 (Jan. 25, 2018). entire document.

Burke, et al., R4, a non-LTR retrotransposon specific to the large subunit rRNA genes of nematodes. Nucleic Acids Res. Nov. 25, 1995; 23(22): 4628-4634.

(Continued)

*Primary Examiner* — Richard G Hutson

(74) *Attorney, Agent, or Firm* — Brown Rudnick LLP; Thomas C. Meyers

(57) ABSTRACT

The present disclosure provides methods and systems for amplifying and analyzing nucleic acid samples. The present disclosure provides methods for preparing cDNA and/or DNA molecules and cDNA and/or DNA libraries using modified reverse transcriptases.

29 Claims, 48 Drawing Sheets

Specification includes a Sequence Listing.

(56) References Cited

U.S. PATENT DOCUMENTS

| | | | |
|---|---|---|---|
| 2014/0323316 | A1 | 10/2014 | Drmanac et al. |
| 2015/0133319 | A1 | 5/2015 | Fu et al. |
| 2015/0141261 | A1 | 5/2015 | Hunicke-Smith et al. |
| 2015/0191781 | A1 | 7/2015 | Ziman et al. |
| 2016/0017320 | A1 | 1/2016 | Wang et al. |
| 2016/0024572 | A1 | 1/2016 | Shishkin et al. |
| 2016/0046985 | A1 | 2/2016 | Drmanac et al. |
| 2016/0194686 | A1 | 7/2016 | Drmanac et al. |
| 2016/0258016 | A1 | 9/2016 | Sandberg et al. |
| 2016/0304946 | A1 | 10/2016 | Betts et al. |
| 2017/0049909 | A1 | 2/2017 | Cullen et al. |
| 2017/0327866 | A1 | 11/2017 | Keene et al. |
| 2017/0369932 | A1 | 12/2017 | Qian et al. |
| 2018/0002735 | A1 | 1/2018 | Drmanac et al. |
| 2018/0044723 | A1 | 2/2018 | Heuermann et al. |
| 2018/0044726 | A1 | 2/2018 | Hunicke et al. |

FOREIGN PATENT DOCUMENTS

| | | | |
|---|---|---|---|
| WO | WO-2015126927 | A2 | 8/2015 |
| WO | WO-2018089860 | A1 | 5/2018 |

OTHER PUBLICATIONS

Co-pending U.S. Appl. No. 16/167,030, filed Oct. 22, 2018.
Co-pending U.S. Appl. No. 16/168,395, filed Oct. 23, 2018.
Cordaux, et al., The impact of retrotransposons on human genome evolution. Nature Reviews Genetics, Oct. 2009; 10:691-703.
Datsenko, K.A. and Wanner, B.L., One-step inactivation of chromosomal genes in *Escherichia coli* K-12 using PCR products. PNAS. Jun. 6, 2000; 97(12): 6640-6645.
Fujimoto et al. "Integration of the 5' end of the retrotransposon, R2Bm, can be complemented by homologous recombination," Nucleic Acids Res, Mar. 3, 2004 (Mar. 3, 2004), vol. 32, pp. 1555-1565. entire document.
Gonzalez, et al., Accurate Expression Profiling of Very Small Cell Populations. PLOS ONE, 2010; 5(12):e14418.
Hashimshony, et al. CEL-Seq: Single-Cell RNA-Seq by Multiplexed Linear Amplification. Cell Rep. Sep. 27, 2012;2(3):666-73. doi: 10.1016/j.celrep.2012.08.003. Epub Aug. 30, 2012.
Hizi, et al., RNA-dependent DNA polymerase of avian sarcoma virus B77. I. Isolation and partial characterization of the alpha, beta2, and alphabeta forms of the enzyme. J. Biol. Chem. Apr. 10, 1997; 252(7): 2281-2289.
Islam, et al. Characterization of the single-cell transcriptional landscape by highly multiplex RNA-seq. Genome Res. Jul. 2011;21(7):1160-7. doi: 10.1101/gr.110882.110. Epub May 4, 2011.
Jamburuthugoda et al. The reverse transcriptase encoded by the non-LTR retrotransposon R2 is as error prone as that encoded by HIV-1, J Mol Bioi, Apr. 15, 2011 (Apr. 15, 2011), vol. 407, pp. 661-672 (pp. 1-18 for citations). entire document.
Kanamori, et al., Unamplified cap analysis of gene expression on a single-molecule sequencer. Genome Res. Jul. 2011; 21(7): 1150-1159.

Kannan et al. "One step engineering of the small subunit ribosomal RNA using CRISPR/Cas9," Scientific Reports, Aug. 4, 2016 (Aug. 4, 2016), vol. 6, pp. 1-10. entire document.
Kurimoto, et al., An improved single-cell cDNA amplification method for efficient high-density oligonucleotide microarray analysis. Nucleic Acids Res. Mar. 17, 2006;34(5):e42. Print 2006.
Kurzynska-Kokorniak et al. "DNA-directed DNA polymerase and strand displacement activity of the reverse transcriptase encoded by the R2 retrotransposon," J Mol Bioi, Nov. 23, 2007 (Nov. 23, 2007), vol. 374, pp. 322-333. entire document.
Le Grice, et al., Subunit—selective mutagenesis indicates minimal polymerase activity in heterodimer-associated p51 HIV-1 reverse transcriptase. EMBO Journal, Dec. 1991; 10(12): 3905-3911.
Lorenzo, et al. PCR-based method for the introduction of mutations in genes cloned and expressed in vaccinia virus. Biotechniques. Feb. 1998;24(2):308-13.
Lutz, et al., Creating multiple-crossover DNA libraries independent of sequence identity. Proc Natl Acad Sci USA. Sep. 25, 2001; 98(20): 11248-53. Epub Sep. 18, 2001.
Ozsolak, et al., Digital transcriptome profiling from attomole-level RNA samples. Genome Res. Apr. 2010;20(4):519-25. doi: 10.1101/gr.102129.109. Epub Feb. 4, 2010.
PCT/US2017/061197 International Search Report and Written Opinion dated Feb. 23, 2018.
Qui, et al., Single-neuron RNA-Seq: technical feasibility and reproducibility. Front Genet. Jul. 6, 2012;3:124. doi: 10.3389/fgene.2012.00124. eCollection 2012.
Saiki, et al. Primer-directed enzymatic amplification of DNA with a thermostable DNA polymerase. Science. Jan. 29, 1988;239(4839):487-91.
Simon, et al., A diversity of uncharacterized reverse transcriptases in bacteria. Nucleic Acids Res. Dec. 2008; 36(22): 7219-7229.
Tang, et al. mRNA-Seq whole-transcriptome analysis of a single cell. Nat Methods. May 2009;6(5):377-82.
Temin, H.M., Reverse transcription in the eukaryotic genome: retroviruses, pararetroviruses, retrotransposons, and retrotranscripts. Molecular Biology and Evolution, Nov. 1, 1985; 2(6): 455-468.
Werner, et al., Asymmetric Subunit Organization of Heterodimeric Rous Sarcoma Virus Reverse Transcriptase $\alpha\beta$: Localization of the Polymerase and RNase H Active Sites in the $\alpha$ Subunit. J Virol. Apr. 2000; 74(7): 3245-3252.
Werner, et al., Soluble Rous Sarcoma Virus Reverse Transcriptasesa,$\alpha\beta$, and $\beta$ Purified from Insect Cells are Processive DNA Polymerases That Lack an RNase H 3' $\rightarrow$ 5' Directed Processing Activity. J. Biol. Chem. 1999; 274(37): 26329-26336.
Xiong, et al., Origin and evolution of retroelements based upon their reverse transcriptase sequences. EMBO J. Oct. 1990;9(10):3353-62.
Zhou, et al. Closed-tube genotyping with unlabeled oligonucleotide probes and a saturating DNA dye. Clin Chem. Aug. 2004;50(8):1328-35. Epub May 27, 2004.
Zoller et al. Oligonucleotide-directed mutagenesis using M13-derived vectors: an efficient and general procedure for the production of point mutations in any fragment of DNA. Nucl. Acids Res.Oct. 25, 1982; 10(20): 6487-6500.

\* cited by examiner

Workflow comparison

Example of a workflow of the present disclosure for constructing a library for sequencing Example of a workflow for constructing a library Example of a workflow using random primers for constructing a library Example of a workflow using fragmented or degraded RNA or DNA with RNA priming for constructing a library Example of a workflow using fragmented or degraded RNA or DNA with RNA priming for constructing a library – method with specific primer Example of a workflow using fragmented or degraded RNA or DNA with a donor complex for constructing a library Example of a workflow using fragmented or degraded RNA or DNA with a donor complex for constructing a library – with specific primer Schematic representation of an N-terminal and a C-terminal truncation of an R2 reverse transcriptase

FIGURE 8

| | | | |
|---|---|---|---|
| SEQ ID NO: 196 | gi\|67625717 | BSLLAFLQM---ESTLMDEHVSTTLMSHARPYTP | RTWTVS-RPKAPAHARAMVS |
| SEQ ID NO: 197 | gi\|168437S893 | SVDLLAFARLQSGIMTPRQVLSLLDLRARTTP | RZWRTVSRRSRQLLMRRIPVM |
| SEQ ID NO: 198 | gi\|34392525 | PLSQFEPGKPSSSTREAINTEYNDMISKMLPSQ | AMMREPRAMPPSTKLM |
| SEQ ID NO: 199 | gi\|34392523 | DMTAVMRGHPDPVTREEIDREPLRMLE---RMR | RRRGYARATRIALMAP |
| SEQ ID NO: 200 | gi\|34392527 | ---KFKQSKVKAMQKENK start | S |
| SEQ ID NO: 201 | gb\|AAB59214.1 | ARVLSELLEGRCR---------RRACRAMRPKT | AGRRWDLMDDRTASMKT |
| SEQ ID NO: 202 | gi\|186163086S | RTAIRRLEEGQSP-EGALIDRRMMVFSDLEVTG | R---RRVARGRAIPVLS |
| SEQ ID NO: 203 | gi\|186163D48D | RAAVCRLRRGCLP-DAALLDWRMRMVFSDLRTAR | ---GRISRGRYRAPVLS |
| SEQ ID NO: 204 | gi\|128S1550 | RTAIRMLLRQSPLDYCTVGCYQTMIRLPVP--- | VRLGGPTYMCMMQSRSMP |
| SEQ ID NO: 205 | gi\|121S082090 | BRALCGDMLNEEQ-----------LIMCIRSMMT | AKCPRGPRTRKTAIMSGT |
| SEQ ID NO: 206 | gi\|1549546 | RVALLMQPMDEGR----------IKSMLSDRFZD | RQKPRGPIYSRTYMGT |
| SEQ ID NO: 207 | gi\|1004394526 | GDRLCDIARRACQDVSQQLLGMLRDVFFVKR | VSTRGQSDLDVDGASVS |
| SEQ ID NO: 208 | gi\|1004173289 | GDRLCDIARRACQDVSQQLLGMLRDVFFVKR | VSTRGQSMLDVDGALVS |
| SEQ ID NO: 209 | gi\|1599127491 | GRRLMETARRAIRGEDITRDLMDYVDTFVVAT | KFMPQAKGKSTTIAPPSS |

Sequence analysis with selected non-long terminal repeat (LTR) retrotransposon and an example of a site of N-terminal truncation upstream two conservative regions (region -1 and region 0)

FIGURE 8 (cont.)

```
                                                    Region 0                              PGPD
------MRDYTQLMKPISVEELKASREDWR---TSPGPDGIRSGQWR--AVPVHLKA
------GVAVGDLMSPITEGEVINTRLPRT---SSPGLDGLTVHRMTTSVPAILRA
------VDGLESVMSPITEGEVINTRLPFS---SAPGLDGLTVNRWEAZVPAILRA
----------EIKNLMRPISNDEIKEVEACKR-TAAGPDQMITAWNSIDECIK---
------SPDLKAIMDPYTEEVRKAKVIANN---TAAGPDGIQPRSMN-RISLKYKT
------APHMETLMDPYSLEIKSARASNE---KGAGPDGVIPRSMN-ALDDRYKR
------ELLARAVMDPISVEEVGRSRVPVG---AAPGPDGIAVSVMNKLPPEAA-A
------GGK-------YSGPEWCSA--GARMNSGERV----EQLPPEAA-A
------MLKDPMPPYTZREIKENLPSFH--SAPGPDGCSARLLA--AVPPLTIQ
------LIDPILPSDVTWALKEMKG--TAGGIDRLTSYDIM--REGKNGILA
------LVEPITGEEVGRTIRLMQN--SSPGLDKLTPRTLR--RFNANYIA
------LMEPLITAEVGSTLKSTTP--SAPGEDKLTLDGVR--RIPIAEIV
------LLDPITTPDEVRQILGSMSS--KAPGPDGHRLSDIR--SIPDDQIC
------LVEPIYAEEVRLVRKSMPT--SAPGEDGIRHKDPM--AVQRLIA
```

FIGURE 8 (cont.)

| | | 700 | 710 | 720 | 730 | 740 | 750 | 760 | 770 |
|---|---|---|---|---|---|---|---|---|---|
| SEQ ID NO: 210 | gi|1130551 | QELQTIIDRAHLEAKETTIQCLSLYLLGITPA | ---------- | ---------- | ---------- | ---------- | ---------- | QGVR-HTL/KEZHRPRN | |
| SEQ ID NO: 211 | gi|12735957 | EVLQSTIDRAMISGREATIQCLSNYLLEITPM | ---------- | ---------- | ---------- | ---------- | ---------- | RXDRPSSATVPARR.PRN | |
| SEQ ID NO: 212 | gi|13559776 | DRLEALCDNICIMPTRLLITTVESYIRKLFKT | ---------- | ---------- | ---------- | ---------- | ---------- | STLKPAQKLRNFSKRWLP | |
| SEQ ID NO: 213 | gi|18616247O4 | TRLIRNTPMEATSGFORTIOKTALYLREVTPAP | ---------- | ---------- | ---------- | ---------- | ---------- | PPRREZHRKKTPNZAPM | |
| SEQ ID NO: 214 | gi|6742750391 | DRLRLIVRSVDDWSRABLREGIGHELRDLPWKP | ---------- | ---------- | ---------- | ---------- | ---------- | ZTPNLAR-VSLPSEDKYS | |
| SEQ ID NO: 215 | gi|1391862173 | RLVDDIVALQPNTSRDIVRSMLPSALDAVGSHE | ---------- | ---------- | ---------- | ---------- | ---------- | PAAHPPLPFGAR-RPFDM | |
| SEQ ID NO: 216 | gi|1397174832 | DRLISDIALRG----VDVLEWLDAYLLEVTAKP | ---------- | ---------- | ---------- | ---------- | ---------- | WAQW-PCPKPPPRAKN | |
| SEQ ID NO: 217 | gi|1397174828 | DRLITDRLQG----DDVLIWLDAYLLEVTAKP | ---------- | ---------- | ---------- | ---------- | ---------- | WAPM-PCPKPLPPVKN | |
| SEQ ID NO: 218 | gi|1397174834 | DQLIRTRQEG----TPTLRDLDLYIRRVTVQP | ---------- | ---------- | ---------- | ---------- | ---------- | ZRQGERQARPLPPPKS | |
| SEQ ID NO: 219 | gi|1213399743 | DNITVQALRKEDVMSDQVFHDLMSYLKLILEPSGNAKS | ---------- | ---------- | VPGHIIMDPSGSAKTSVTRAPKPATYSSSL | ---------- | ---------- | | |
| SEQ ID NO: 220 | gi|1954238165 | VMSCDLIKEATCGMAMDIVELQSNIRKLFSSGR | ---------- | ---------- | ---------- | ---------- | ---------- | KLPMKLRGAREAVQN | |
| SEQ ID NO: 221 | gi|1954280597 | VMSCELIKQATGMAIVDIKELQNMLRKVFSSGR | ---------- | ---------- | ---------- | ---------- | ---------- | NLPAKSHGVRESYPKK | |
| SEQ ID NO: 222 | gi|1954380717 | VMSCDLIKEATCGMAMDIMELQSNIRKVFSSGR | ---------- | ---------- | ---------- | ---------- | ---------- | KLPVKRSGAREYVQN | |
| SEQ ID NO: 223 | gi|1954202918 | RDLRHHIEDSLTSQSMSELEGLIMFLETNKILKSREDENMKYDDVISIVZEFVCKPNGRQPPPARKTKEZPKN | | | | | | | |

FIGURE 9

Purification of a wild type R2 reverse transcriptase and an N-terminal truncated R2 reverse transcriptase PAGE gel showing activity and template jumping properties of R2 enzyme and MMLV using synthetic RNA Workflow for sequencing library preparation Real-time PCR data of library preparation based on 1-pot (e.g., single vessel) reactions Gel showing amplicon 1-pot (e.g., single vessel) RNA library prep using different template amounts 1-pot (e.g., single vessel) RNA library prep using different template lengths Enzyme activity and template jumping is dependent on NaCl concentration Enzyme activity based on nickel and/or heparin affinity purification Template jumping properties based on nickel and/or heparin affinity purification R2 enzyme activity and template jumping in the presence of DNA template (lane 1: no enzyme control; lane 2: 0.023 µg/µl enzyme in the presence of DNA template)

Workflow of a method of the present disclosure for sequencing a library preparation from liquid biopsy Sample DNA fragment was captured by an R2 enzyme with both an RNA priming approach and an RNA donor approach Sample DNA fragment (at various concentrations) was captured by an R2 enzyme using an RNA priming approach Sample DNA fragment (at various concentrations) was captured by an R2 enzyme using an RNA donor approach Sample DNA fragment was captured using an RNA donor approach at a concentration as low as 500 femtomolar Sensitivity driver for liquid biopsy application. Data shows sensitivity up to 0.3 pg of DNA.

Schematic method for increasing the detection sensitivity of low frequency mutations by using cell-free nucleic acids comprising cell-free DNA and RNA.

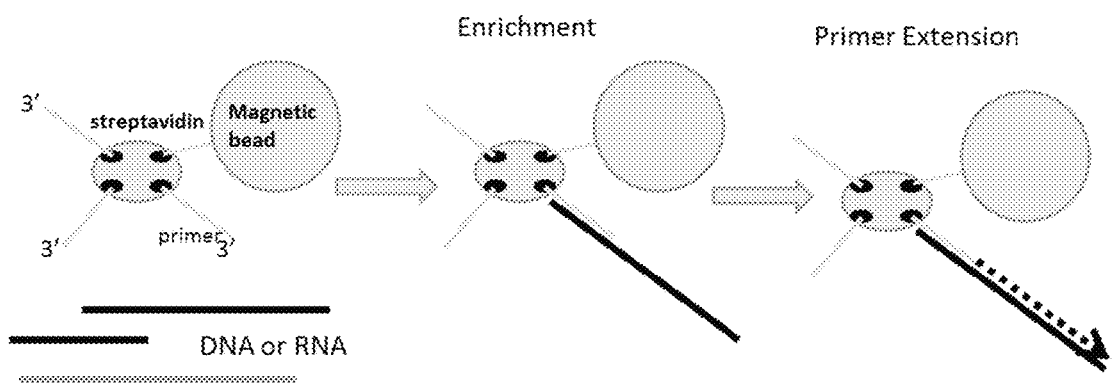

FIGURE 22A

Improvement in priming, specific template capture and template jumping efficiency by using streptavidin-immobilized oligonucleotides capable of binding to specific DNA and/or RNA template(s).

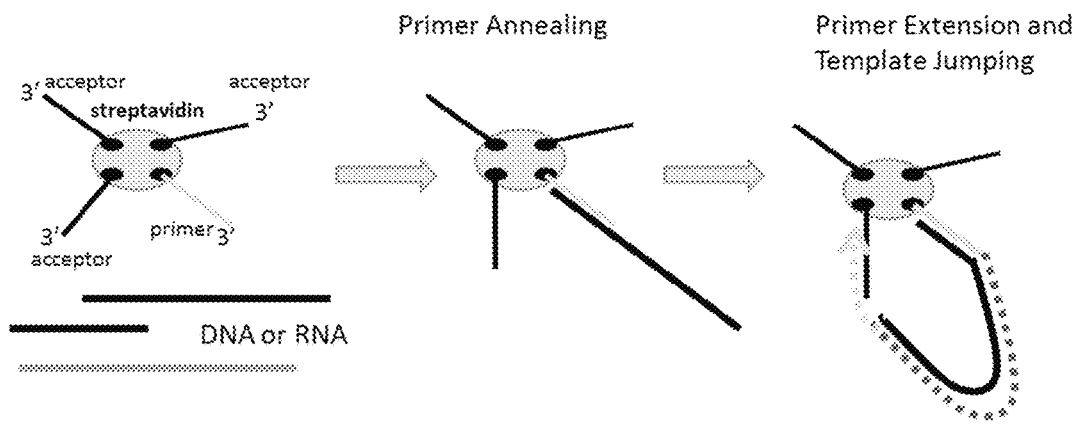

FIGURE 22B

A complex comprising streptavidin bound to both an oligonucleotide primer and an oligonucleotide acceptor is capable of binding to specific DNA and/or RNA template(s), allowing for primer extension and template jumping.

Streptavidin bound to a magnetic bead allows for enrichment of DNA and/or RNA template(s).

Template Concatemerization

FIGURE 23B

Workflow of template concatemerization

Gel showing the concatemerization of a 200bp DNA fragment

Schematic representation of primer extension using a reverse transcriptase and a companion enzyme BioAnalyzer trace data of next-generation sequencing (NGS) libraries: (1) Fragmented RNA seq library from plasma; (2) not fragmented RNA seq library from plasma Method of generating cfDNA library Method of generating cfDNA library Library preparation: pulling ribosomal RNA and/or transfer RNA and/or PCR products using complementary oligonucleotide attached to magnetic beads or solid support to maximize sequencing capacity Library preparation: oligonucleotide-guided degradation of ribosomal RNA and/or transfer RNA and/or PCR products to maximize sequencing capacity

METHODS FOR PROCESSING NUCLEIC ACID SAMPLES

CROSS-REFERENCE

This application is a continuation of International Application No. PCT/US2017/061197, filed Nov. 10, 2017, which claims the benefit of U.S. Provisional Application No. 62/421,028, filed Nov. 11, 2016 and U.S. Provisional Application No. 62/477,211, filed Mar. 27, 2017, each of which is entirely incorporated herein by reference.

SEQUENCE LISTING

The instant application contains a Sequence Listing which has been submitted in ASCII format via EFS-Web and is hereby incorporated by reference in its entirety. Said ASCII copy, created on Oct. 18, 2018, is named 51160_701_301_SL.txt and is 732,332 bytes in size.

BACKGROUND

A common technique used to study gene expression in living cells is to produce complementary deoxyribonucleic acid (cDNA) from a ribonucleic acid (RNA) molecule. This technique provides a means to study RNA from living cells which avoids the direct analysis of inherently unstable RNA. As a first step in cDNA synthesis, the RNA molecules from an organism are isolated from an extract of cells or tissues of the organism. After messenger RNA (mRNA) isolation, using methods such as affinity chromatography utilizing oligo dT (a short sequence of deoxy-thymidine nucleotides), oligonucleotide sequences are annealed to the isolated mRNA molecules and enzymes with reverse transcriptase activity can be utilized to produce cDNA copies of the RNA sequence, utilizing the RNA/DNA primer as a template. Thus, reverse transcription of mRNA is a key step in many forms of gene expression analyses. Generally, mRNA is reverse transcribed into cDNA for subsequent analysis by primer extension or polymerase chain reaction.

Reverse transcriptase has both an RNA-directed DNA polymerase activity and a DNA-directed DNA polymerase activity. The reverse transcription of RNA templates may require a primer sequence which is annealed to an RNA template in order for DNA synthesis to be initiated from the 3' OH of the primer. At room temperature, reverse transcriptase enzymes may allow formation of both perfectly matched as well as mismatched DNA/RNA hybrids. In some instances, a reverse transcriptase enzyme can produce large amounts of non-specific cDNA products as a result of such non-specific priming events. The products of non-specific reverse transcription can interfere with subsequent cDNA analyses, such as cDNA sequencing, real-time polymerase chain reaction (PCR), and alkaline agarose gel electrophoresis, among others. Non-specific cDNA templates produced by non-specific reverse transcriptase activity can present particular difficulties in applications such as real-time PCR. In particular, such non-specific cDNA products can give rise to false signals which can complicate the analysis of real-time PCR signals and products. Thus, the reduction of non-specific reverse transcriptase activity may result in greater specificity of cDNA synthesis. Currently, there are no reliable and easy to use methods for improving the specificity of reverse transcription. The present disclosure satisfies these and other needs.

Several approaches may be used for obtaining transcriptome data from single cells. A pioneer approach used reverse transcriptase and oligo-dT primers with a T7 phage RNA polymerase promoter sequence attached to the 5' end of the oligo-dT run. The resulting cDNA was transcribed into multiple copies of RNA which were then converted back to cDNA (Phillips, et al., Methods 10(3):283-288 (1996)). This often truncates the cDNA molecule, losing 5' sequences of the original mRNA, especially for relatively long transcripts, and requires multiple rounds of processing when starting with low quantity (LQ) of cells, further exacerbating cDNA truncation. A recent modification (Hashimshony, et al., Cell Rep. 2(3):666-673 (2012)) enables multiplex analyses, but this is still 3' end sequence biased. Other methods ar based on PCR amplification of cDNA (Liu, et al., Methods Enzymol. 303:45-55 (1999), Ozsolak, et al., Genome Res. 20(4):519-525 (2010), Gonzalez, et al., PLoS ONE. 5(12):e14418 (2010), Kanamori, et al., Genome Res. 21(7):1150-1159 (2011). Islam, et al., Genome Res. 21(7):1160-1167 (2011), Tang, et al., Nat. Methods. 6(5):377-382 (2009), Kurimoto, et al., Nucleic Acids Res. 34(5):e42 (2006). Qiu S, et al., Front Genet. 3:124 (2012)).

These approaches, however, may yield biased representations of sequences along the mRNA, and fail to give complete sequences for mRNAs (e.g., long mRNAs) because DNA templates (e.g., long DNA templates) are discriminated against even when a long PCR reaction is used.

SUMMARY

The present disclosure provides methods of amplifying cDNA from RNA isolated from low quantities of cells and/or single cells. The present disclosure also provides methods of transcriptome analysis where cells do not go through stress (e.g. elevated temperature for cDNA analysis), thus maintaining the transcriptome profile.

In one embodiment, the present disclosure relates to a method for preparing a complementary deoxyribonucleic acid (cDNA) molecule comprising:
  (a) annealing a primer to a template nucleic acid molecule, thereby generating an annealed template nucleic acid molecule; and
  (b) mixing, in the presence of nucleotides,
    i. said annealed template nucleic acid molecule;
    ii. one or more acceptor nucleic acid molecules; and
    iii. a modified reverse transcriptase, wherein said modified reverse transcriptase generates a plurality of continuous complementary deoxyribonucleic acid molecules by: i) reverse transcribing a sequence of said annealed template nucleic acid molecule: ii) migrating to an acceptor nucleic acid molecule; and iii) reverse transcribing a sequence of said acceptor nucleic acid molecule at a temperature of from about 12° C. to about 42° C. with an error rate of at most about 5%.

In some embodiments, the migrating is independent of sequence identity between the template and the acceptor nucleic acid molecule. In some embodiments, (a) and (b) are performed in a single vessel. In some embodiments, the method further comprises performing the method on a heterogeneous plurality of template nucleic acid molecules comprising a plurality of distinct ribonucleic acid (RNA) molecules. In some embodiments, the plurality of distinct ribonucleic acid molecules comprise messenger RNAs (mRNAs), ribosomal RNAs (rRNAs), transfer RNAs (tRNAs), micro RNAs (miRNAs), and long non-coding RNAs (lncRNAs). In some embodiments, the plurality of continuous complementary deoxyribonucleic acid molecules is prepared in at most about 2 hours. In some embodiments, the template nucleic acid molecule is selected from the group consisting of an artificially fragmented DNA template, a naturally fragmented DNA template, an artificially fragmented ribonucleic acid (RNA) template, a naturally fragmented ribonucleic acid (RNA) template, or a combination thereof.

In some embodiments, the modified reverse transcriptase amplifies said annealed template nucleic acid molecule at a processivity of at least about 80% per base. In some embodiments, the modified reverse transcriptase comprises at least one improved enzyme property relative to a wild type unmodified reverse transcriptase. In some embodiments, at least one improved enzyme property is selected from the group consisting of: higher thermo-stability, higher specific activity, higher processivity, higher strand displacement, higher end-to-end template jumping, higher affinity, and higher fidelity relative to said wild type unmodified reverse transcriptase. In some embodiments, modified reverse transcriptase is an R2 reverse transcriptase. In some embodiments, the modified reverse transcriptase has at least about 90% identity to SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, or SEQ ID NO: 67, and contains at least one substitution modification relative to SEQ ID NO: 52.

In some embodiments, the method further comprises adding a tag to the template nucleic acid molecule, thereby generating a plurality of tagged continuous complementary deoxyribonucleic acid molecules after performing (a) and (b). In some embodiments, the method further comprises sequencing the tagged plurality of continuous complementary deoxyribonucleic acid molecules. In some embodiments, modified reverse transcriptase further comprises a tag. In some embodiments, the tag is selected from the group consisting of biotin, azido group, acetylene group, His-tag, calmodulin-tag, CBP, CYD, Strep II. FLAG-tag, HA-tag, Myc-tag, S-tag, SBP-tag, Sofiag-1, Softag-3, V5-tag, Xpress-tag, isopeptag, SpyTag B, HPC peptide tags, GST, MBP, biotin carboxyl carrier protein, glutathione-S-transferase-tag, green fluorescent protein-tag, maltose binding protein-tag, Nus-tag, Strep-tag, and thioredoxin-tag.

In some embodiments, the method further comprises performing a polymerase chain reaction (PCR) amplification reaction, thereby forming one or more amplicons. In some embodiments, (a) and (b) and the PCR amplification reaction are performed in the same vessel. In some embodiments, the PCR amplification is performed at a temperature sufficient to inactivate the reverse transcriptase.

In some embodiments, the one or more acceptor nucleic acid molecules comprise a modified nucleotide that stops the reverse transcription by the modified reverse transcriptase. In some embodiments, the method further comprises obtaining a sample comprising one or more template nucleic acid molecules from a subject and annealing one or more primers to said one or more template nucleic acid molecules. In some embodiments, the sample is a tissue sample. In some embodiments, the sample comprises one or more cell free nucleic acids and the method further comprises performing the reaction of (a) and (b) in the same vessel.

In some embodiments, the method further comprises depleting at least one ribosomal RNA (rRNA) from the sample comprising one or more template nucleic acid molecules prior to annealing one or more primers. In some embodiments, depleting the at least one ribosomal RNA (rRNA) comprises hybridization of an oligonucleotide to the rRNA. In some embodiments, depleting said at least one ribosomal RNA (rRNA) comprises an oligonucleotide probe-guided endonucleolitic cleavage of the rRNA. In some embodiments, the one or more template nucleic acid molecules comprise at least one transfer RNA (tRNA) and the method further comprises depleting the at least one tRNA from the one or more template nucleic acid molecules prior to annealing one or more primers.

In some embodiments, the method is performed in the absence of purification of one or more annealed template nucleic acid molecules. In some embodiments, the method further comprises purifying the mixture comprising a plurality of continuous complementary deoxyribonucleic acid molecule. In some embodiments, purifying comprises two purification steps. In some embodiments, the two purification steps comprise a nickel and a heparin affinity purification steps.

In some embodiments the method is performed on from about 0.1 nM to about 100 nM of one or more template nucleic acid molecules. In some embodiments, the method further comprises annealing one or more random primer(s) to the template nucleic acid molecule. In some embodiments, a primer hybridizes to one or more adapter sequence. In some embodiments, the template nucleic acid molecule is derived from a single cell.

In one embodiments, the present disclosure relates to a method for preparing a complementary deoxyribonucleic acid molecule comprising:
(a) annealing one or more primers to an amount of template nucleic acid molecules, thereby generating one or more annealed template nucleic acid molecules; and
(b) mixing, in the presence of nucleotides,
  i. said one or more annealed template nucleic acid molecules;
  ii. one or more acceptor nucleic acid molecules; and
  iii. a modified reverse transcriptase, whereby said modified reverse transcriptase generates a plurality of continuous complementary deoxyribonucleic acid molecule by reverse transcribing a sequence of an annealed template nucleic acid molecule, migrating to an acceptor nucleic acid molecule, and reverse transcribing a sequence of said acceptor nucleic acid molecule without thermal cycling in a single reaction vessel.

In some embodiments, the migrating is independent of sequence identity between the template and the acceptor nucleic acid molecule. In some embodiments, the plurality of continuous complementary deoxyribonucleic acid molecules are prepared in at most about 2 hours. In some embodiments, the amount of template nucleic acid molecules is selected from the group consisting of an artificially fragmented DNA template, a naturally fragmented DNA template, an artificially fragmented ribonucleic acid (RNA) template, a naturally fragmented ribonucleic acid (RNA) template, or a combination thereof. In some embodiments, the amount of template nucleic acid molecules comprises one or more cell free nucleic acids. In some embodiments, the modified reverse transcriptase comprises at least one improved enzyme property relative to a wild type unmodified reverse transcriptase. In some embodiments, the improved enzyme property is selected from the group consisting of: higher thermo-stability, higher specific activity, higher processivity, higher strand displacement, higher end-to-end template jumping, higher affinity, and higher fidelity relative to said wild type unmodified reverse transcriptase. In some embodiments, the modified reverse transcriptase is an R2 reverse transcriptase. In some embodiments, the modified reverse transcriptase has at least 90% identity to SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63. SEQ ID NO: 64, SEQ ID NO: 65, SEQ ID NO: 66, or SEQ ID NO: 67 and contains at least one substitution modification relative to SEQ ID NO: 52.

In some embodiments, the method further comprises adding a tag to the amount of template nucleic acid molecules, thereby generating a plurality of tagged continuous complementary deoxyribonucleic acid molecules after performing (a) and (b). In some embodiments, the method further comprises sequencing the plurality of tagged continuous complementary deoxyribonucleic acid molecules. In some embodiments, the modified reverse transcriptase comprises a tag. In some embodiments, the tag is selected from the group consisting of biotin, azido group, acetylene group, His-tag, calmodulin-tag, CBP, CYD, Strep II, FLAG-tag, HA-tag, Myc-tag. S-tag. SBP-tag, Softag-1, Softag-3, V5-tag. Xpress-tag, isopeptag, SpyTag B, HPC peptide tags, GST, MBP, biotin carboxyl carrier protein, glutathione-S-transferase-tag, green fluorescent protein-tag, maltose binding protein-tag, Nus-tag, Strep-tag, and thioredoxin-tag. In some embodiments, the one or more acceptor nucleic acid molecules comprises a modified nucleotide that stops the reverse transcription by said modified reverse transcriptase.

In some embodiments, the method further comprises obtaining a sample from a subject. In some embodiments, the sample comprises one or more cell free nucleic acids and the method further comprises performing the reaction of (a) and (b) in the same vessel. In some embodiments, the sample is a tissue sample. In some embodiments, the method further comprises depleting at least one ribosomal RNA (rRNA) from the one or more template nucleic acid molecules prior to annealing one or more primers. In some embodiments, depleting said at least one ribosomal RNA (rRNA) comprises hybridization of an oligonucleotide to the rRNA. In some embodiments, depleting the at least one ribosomal RNA (rRNA) comprises an oligonucleotide probe-guided endonucleolitic cleavage of the rRNA. In some embodiments, depleting at least one transfer RNA (tRNA) from the amount of template nucleic acid molecules is prior to annealing one or more primers.

In some embodiments, the method is performed in the absence of purification of one or more annealed template nucleic acid molecules. In some embodiments the method further comprises purifying the mixture comprising the plurality of continuous complementary deoxyribonucleic acid molecules. In some embodiments, purifying comprises two purification steps. In some embodiments, the two purification steps comprise a nickel and a heparin affinity purification steps. In some embodiments, the amount of template nucleic acid molecules is from about 0.1 nM to about 100 nM of said one or more template nucleic acid molecules. In some embodiments, the one or more primers comprise one or more random primer(s). In some embodiments, the one or more primers is hybridized to one or more adapter sequence. In some embodiments, the amount of template nucleic acid molecules are derived from a single cell.

In one embodiment, the present disclosure relates to a polypeptide having reverse transcriptase activity comprising an amino acid sequence that has at least 90% identity to SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, or SEQ ID NO: 67 and contains at least one substitution modification relative to SEQ ID NO: 52.

In one embodiment, the present disclosure relates to a purified polypeptide comprising one or more domains from an R2 reverse transcriptase wherein said purified polypeptide generates one or more copies of a complementary deoxyribonucleic acid molecule from a template nucleic acid molecule with an error rate of at most about 5%.

In some embodiments, the polypeptide reverse transcribes a template nucleic acid molecule at a processivity of at least about 80% per base. In some embodiments, the polypeptide reverse transcribes a template nucleic acid molecule at a temperature of from about 12° C. to about 42° C. In some embodiments, the polypeptide comprises an amino acid sequence as set forth in SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, or SEQ ID NO: 67.

In one embodiment, the present disclosure relates to a non-naturally occurring enzyme comprising one or more domains from an R2 reverse transcriptase wherein the non-naturally occurring enzyme generates a complementary deoxyribonucleic acid product in a time period of less than about three hours and at a performance index greater than 1.0 for at least one enzyme property selected from the group consisting of improved stability, specific activity, protein expression, purification, processivity, strand displacement, template jumping, increased DNA/RNA affinity, and fidelity, as compared to a purified enzyme of SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64. SEQ ID NO: 65, SEQ ID NO: 66, or SEQ ID NO: 67.

In some embodiments, an R2 reverse transcriptase and/or a non-naturally occurring enzyme and/or a polypeptide can have at least one mutation and/or modification. In some embodiments, an R2 and/or a non-naturally occurring enzyme and/or a polypeptide comprises a C952S, and/or C956S, and/or C952S, C956S (double mutant), and/or C969S, and/or H970Y, and/or R979Q, and/or R976Q, and/or R1071S, and/or R328A, and/or R329A, and/or Q336A, and/or R328A, R329A, Q336A (triple mutant), and/or G426A, and/or D428A, and/or G426A, D428A (double mutant) mutation, and/or any combination thereof.

In one embodiment, the present disclosure relates to a method comprising:
   (a) adding a nuclease complex to a plurality of double-stranded nucleic acid molecules, wherein said nuclease complex comprises:
      i. a Cas9 nuclease or a functional variant thereof; and
      ii. at least one synthetic guide oligonucleotide, wherein said synthetic guide oligonucleotide is complementary to a ribosomal ribonucleic acid (rRNA) or transfer ribonucleic acid (tRNA) region in at least one double-stranded nucleic acid molecule in said plurality of double-stranded nucleic acid molecules;
   (b) permitting said complex to cleave said rRNA or tRNA region of at least one double-stranded nucleic acid molecule, thereby providing at least one cleaved double-stranded nucleic acid molecule, and (c) subjecting said at least one cleaved double-stranded nucleic acid molecule or derivative thereof to nucleic acid sequencing, thereby yielding a nucleic acid sequence of said at least one double-stranded nucleic acid molecule lacking said rRNA or tRNA region.

In some embodiments, the synthetic guide oligonucleotide is complementary to a ribosomal ribonucleic acid (rRNA). In some embodiments, the synthetic guide oligonucleotide is complementary to a transfer ribonucleic acid (tRNA). In some embodiments, the method does not require denaturation of the plurality of double-stranded molecules comprising sequences derived from rRNAs and tRNAs prior to sequencing. In some embodiments, the plurality of double-stranded nucleic acid molecules comprise a cDNA.

In some embodiments, the method does not require denaturation of the plurality of double-stranded molecules comprising sequences derived from rRNAs and/or tRNAs. In some embodiments, the plurality of double-stranded nucleic acid molecules comprises sequences derived from an rRNA and/or a tRNA. In some embodiments, the double-stranded nucleic acid molecules comprises cDNA. In some embodiments, the pre-determined region is a region of an rRNA. In some embodiments, the pre-determined region is a region of a tRNA.

In one embodiment, the present disclosure relates to a method for preparing a concatemer of nucleic acid molecules comprising:

(a) processing ends of a plurality of double-stranded nucleic acid molecules;

(b) adding a first plurality of adaptor molecules to said plurality of double stranded nucleic acid molecules, wherein said first plurality of adaptor molecules comprise one or more overhang sequences, wherein at least two overhang sequences are complementary to each other, thereby providing a first plurality of adaptor connected double-stranded nucleic acid molecules;

(c) adding a polymerizing enzyme to said first plurality of adaptor connected double-stranded nucleic acid molecules in the absence of a primer, whereby said polymerizing enzyme forms a first set of adaptor connected double-stranded nucleic acid concatemers by joining two or more adaptor connected double-stranded nucleic acid molecules by said one or more overhang sequences;

(d) adding a second plurality of adaptor molecules to said first set, wherein said second plurality of adaptor molecules comprise one or more overhang sequences, wherein at least two overhang sequences are complementary to each other, thereby providing a second set of adaptor connected double-stranded nucleic acid molecules;

(e) repeating (a)-(c) with a set of adaptor molecules to yield a concatemer comprising a predetermined average length.

In some embodiments, the processing of (a) comprises end repair. In some embodiments, the polymerizing enzyme is a reverse transcriptase. In some embodiments, the reverse transcriptase is an R2 reverse transcriptase or a functional variant thereof. In some embodiments, the first plurality of adaptor molecules, the second plurality of adaptor molecules, or both comprise a unique molecular identifier sequence (UMI). In some embodiments, the polymerizing enzyme joins two or more adaptor connected double-stranded nucleic acid molecules in a PCR or isothermal amplification reaction. In some embodiments, the first plurality of adaptor molecules, the second plurality of adaptor molecules, or both comprise at least one modified nucleotide In some embodiments, the adaptor comprises a unique molecular identifier sequence (UMI). In some embodiments, the amplifying is performed by PCR or isothermal amplification. In some embodiments, the adaptor comprises at least one modified nucleotide.

Advantages of the present disclosure include, but is not limited to: efficient and simple method for cDNA and nucleic acid library preparation (e.g., single cell and/or bulk library preparation) that is compatible with various sequence technologies; high quality library preparation that can be used for single cell nucleic acid (e.g., RNA) sequencing and bulk nucleic acid (e.g., RNA) sequencing; modified reverse transcriptase enzymes with improved enzyme property; high conversion (e.g., efficiency and/or fidelity) of a nucleic acid sample (e.g., RNA, and/or mRNA, and/or DNA) to nucleic acid (e.g., cDNA) library; low non-specific products yield; and transcriptome analysis where cells don't go through stress (e.g., no need for elevated temperature for cDNA synthesis) because nucleic acid synthesis may be performed at ambient temperatures (e.g., 30° C.).

Advantages of the present disclosure also include the ability to produce a nucleic acid (e.g., cDNA) library using random or multi-priming and/or a library from fragmented/degraded nucleic acid molecule(s) (e.g., RNA and DNA), even at low amounts (e.g., 500 femtomolar) of fragmented/degraded nucleic acid molecule(s). Advantages of the present disclosure also include the ability of the disclosed methods (e.g., by using a modified reverse transcriptase) to amplify a fragment (e.g., amplification of the full fragment) and generate multiple copies of the full fragment for sequencing. Current available methods may cause a fragment to be amplified at a random location and may only amplify sections of the fragment, thus sequencing and identification of the fragment(s) according to current methods is not available at low amounts. Advantages of the present disclosure also include amplification via a single step or via a two step amplification protocol, thus increasing specificity and efficiency. Current methods include multiple step amplification that can result in low yield, low efficiency, and/or low specificity. Another advantage of the methods of the present disclosure is the capability to prime using a piece of nucleic acid molecule (e.g., RNA) that does not have to be complementary to a template. Another advantage of the present disclosure is the ability of the modified enzymes to template jump at room temperature and/or at temperatures as low as about 30° C. Another advantage of the present disclosure is the ability to prepare a library from a sample in less than three steps (FIG. 1) and/or less than 4 hours. This advantage is particular important for clinical research and testing and the medical field. Another advantage of the present disclosure is the ability of the methods disclosed herein (e.g., by using a modified reverse transcriptase) to improve template jumping, processivity, strand displacement properties, enzyme activity, and/or fidelity.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications, and NCBI accession numbers mentioned in this specification are herein incorporated by reference to the same extent as if each individual publication, patent, patent application, or NCBI accession number was specifically and individually indicated to be incorporated by reference. To the extent publications and patents, patent applications, or NCBI accession numbers incorporated by reference contradict the disclosure contained in the specification, the specification is intended to supersede and/or take precedence over any such contradictory material.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings (also "Figure" and "FIG." herein), of which:

FIG. 1 also illustrates a difference between preparing a sample for sequencing from a liquid biopsy sample based on a traditional method and the method of the present disclosure. The traditional method involves a protocol that requires about 1 to 2 days and more than 4-5 hours of hands-on time, while the method of the present disclosure involves a protocol that requires less than about 2 hours and less than about 30 minutes of hands-on time;

FIG. 20 discloses that the methods described herein show high sensitivity compared to current available technology (e.g., the methods disclosed herein can be used for very low DNA amounts, as low as 0.3 pg, which is about a 100-1000 fold higher sensitivity than current available methods). Data also shows the potential for applications involving DNA amounts that are even lower than 0.3 pg (e.g., a few orders of magnitude lower);

FIG. 21 also illustrates a method of the present disclosure that driscriminately tag cell-free DNA and RNA present in the same, or different, tube (e.g., same PCR tube). Tagging facilitates post-sequencing analysis by allowing discrimination between sequences that originated from DNA and RNA templates. FIG. 21 shows that two different analytes, DNA and RNA, were polytailed in the presence of Terminal Deoxynucleotidyl Transferase (TdT), Poly A Polymerase, and specific nucleotide substrates dCTP (or alternatively dGTP or dTTP) and ATP. In short, a reaction containing both RNA and DNA (dsDNA and ssDNA) was mixed and incubated with poly A polymerase, TdT, dCTP, and ATP (FIG. 21). Poly A polymerase preferentially extends RNA using the preferred substrate ATP while TdT preferentially extends DNA using the preferred deoxy substrate dCTP. In general, the reaction can be performed with both enzymes (e.g., poly A polymerase and TdT) at the same time, or alternatively, it can be performed sequentially with one enzyme at a time;

FIG. 22A illustrates that streptavidin-immobilized oligonucleotides can be used for improving the efficiency of specific template capture and template jumping capabilities. FIG. 22A shows that streptavidin-immobilized oligonucleotides bind to specific DNA and/or RNA template(s). In this case, the streptavidin-immobilized oligonucleotides are bound to magnetic beads. Once the specific DNA and/or RNA template is bound to the streptavidin-magnetic bead complex, the template can be enriched. The oligonucleotide can be used as a primer and the template can be transcribed in the presence of an enzyme (e.g., R2 enzyme);

FIG. 22B illustrates that a complex comprising of streptavidin bound to both an oligonucleotide primer and an oligonucleotide acceptor is capable of binding to specific DNA and/or RNA template(s). In short, the specific template binds to the oligonucleotide primer, which can then be extended in the presence of an enzyme (e.g., R2 enzyme). The primer extension then undergoes template jumping due to the close proximity between the acceptor oligonucleotide and the specific template;

Figure 23B:
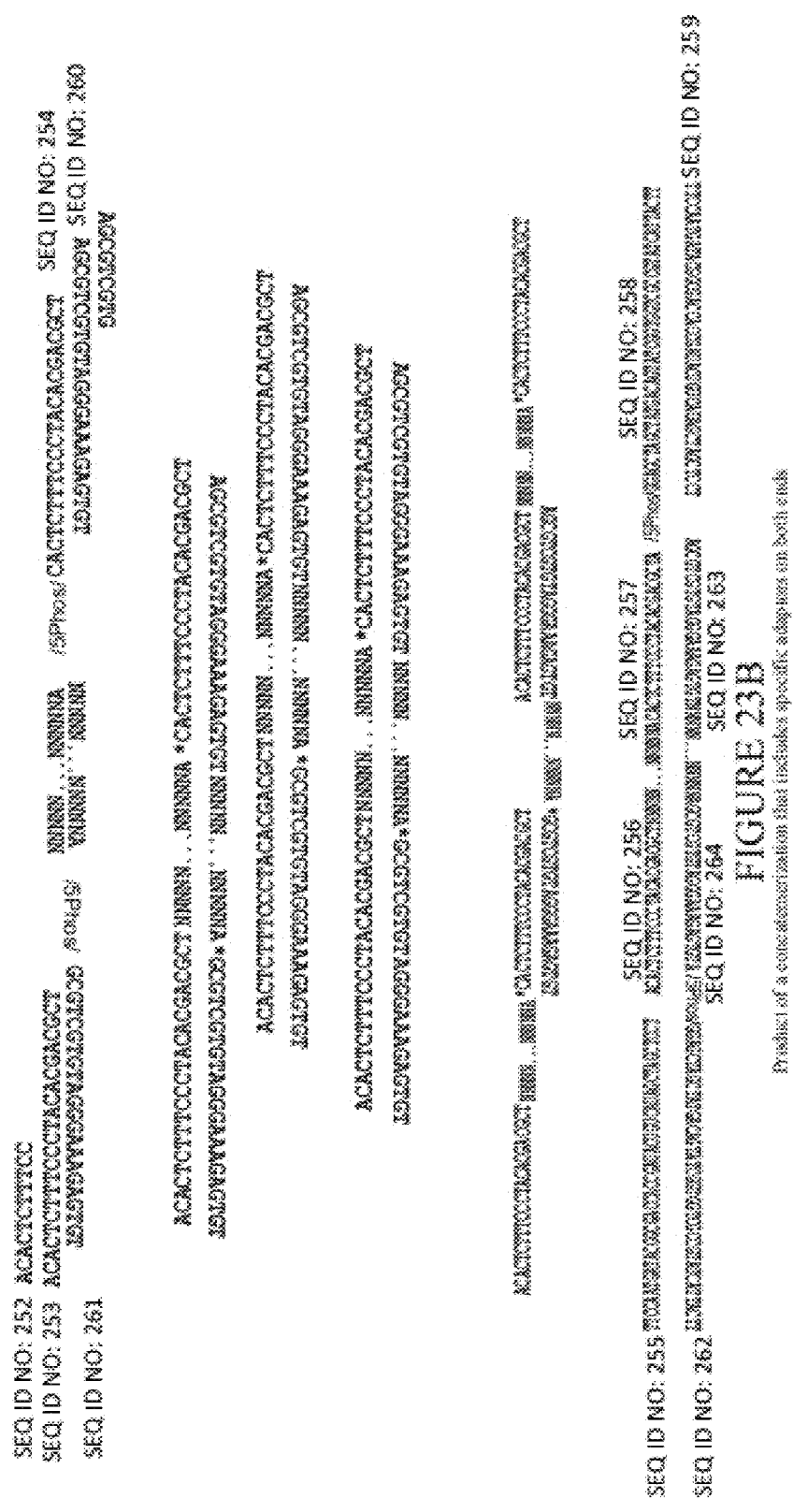

FIGS. 23A and 23B illustrate template concatemerization. Some sequencing technologies have a long sequencing read-length (~500 bp to ~50000 bp) while others have a short sequencing read-length (~50 bp to ~250 bp). Most of the isolated cell-free DNA and RNA from body fluids are short fragments (~20 bp to ~200 bp). The method shown in FIGS. 23A and 23B is particularly suitable for sequencing technologies that have a long sequencing read-length because the method is capable of forming long template concatemers. FIG. 23A illustrates a method of concatemerizing several templates separated by signaling sequences. In this method, short dsDNA fragments are converted to a long concatemer separated by signaling sequences. FIG. 23B shows a final product of a concatemerization that includes specific adaptors on both ends. The adaptor design incorporates unique molecular identifier sequences (UMI) that allow one to trace the tagged molecule and also help reduce errors during data analysis. In short, dsDNA fragments are ligated with two or more adaptors. The ligated fragments are then extended using PCR without primers (alternatively isothermal amplification). The concatemer length or the number of attached templates can be determined, for example, by tagging the adaptors with modified nucleotides (e.g., by introducing methylated nucleotides or by inserting dUTP). The length of the concatemer can be regulated based on the ratio between modified/unmodified adaptors. The adaptor sequences can serve as a homology priming location (annealed to the homology spot ssDNA fragments serve as template and primer). The reaction in the PCR undergoes a selected number of cycles (the more cycles, the longer the concatemer) or time (isothermal amplification). The reaction is then stopped and the long dsDNA concatemers are ligated with two unique dsDNA adaptors. See also, Example 13;

FIG. 25 shows a reaction scheme which starts with the annealing of a primer to an RNA template (the primer can be annealed to a specific sequence, or to a polyA tail, or to a product of poly-tailing of the 3' end). The reaction is then mixed with an enzyme (e.g., R2 enzyme), a polymerase with editing activity (e.g., 3' to 5' exonuclease), and an acceptor template (e.g., acceptor template with a protected 3' end). The acceptor template may include bases at the 3' end to protect it against exo digestion. Examples of nucleotides that can be used to protect the acceptor template include, but are not limited to, ribonucleotides, thiophosphates, and nucleotide bases with or without modification. Alternatively, the reaction shown in FIG. 25 can be executed in a single step if, for example, a proper ratio of primer to exonuclease is used. As shown in FIG. 25, if the R2 reverse transcriptase dissociates from the DNA/RNA heteroduplex before completion of the jumping to the acceptor template, the product is overextended (3' overhang). The 3' to 5' exonuclease activity can then regenerate the bland end structure of the DNA/RNA duplex. In general, jumping to the acceptor template can be completed by a multi-turnover mechanism, thus increasing the yield of the reaction:

FIG. 31 shows cell free RNA library that was obtained according to the methods of the present disclosure. The graph corresponds to Illumina sequencing results of library prepared from 20 ng cell free RNA (cfRNA). 28357171 reads were analyzed, 91.9% mapped. Examples of captured items/analytes included, but was not limited to, vault RNA, tRNA, srpRNA, sRNA, snRNA, snoRNA, scRNA, scaRNA, rRNA, RNA, long non-coding RNAs (ncRNAs), micro RNA (miRNA), macro lnc RNA, miscellaneous RNA, 3 prime overlapping ncRNA, DNA, bidirectional promoter incRNA, lincRNA, MT_tRNA, MT_rRNA, ribozyme, LTR, retroposon, and SINE.

DETAILED DESCRIPTION

Figure 1:
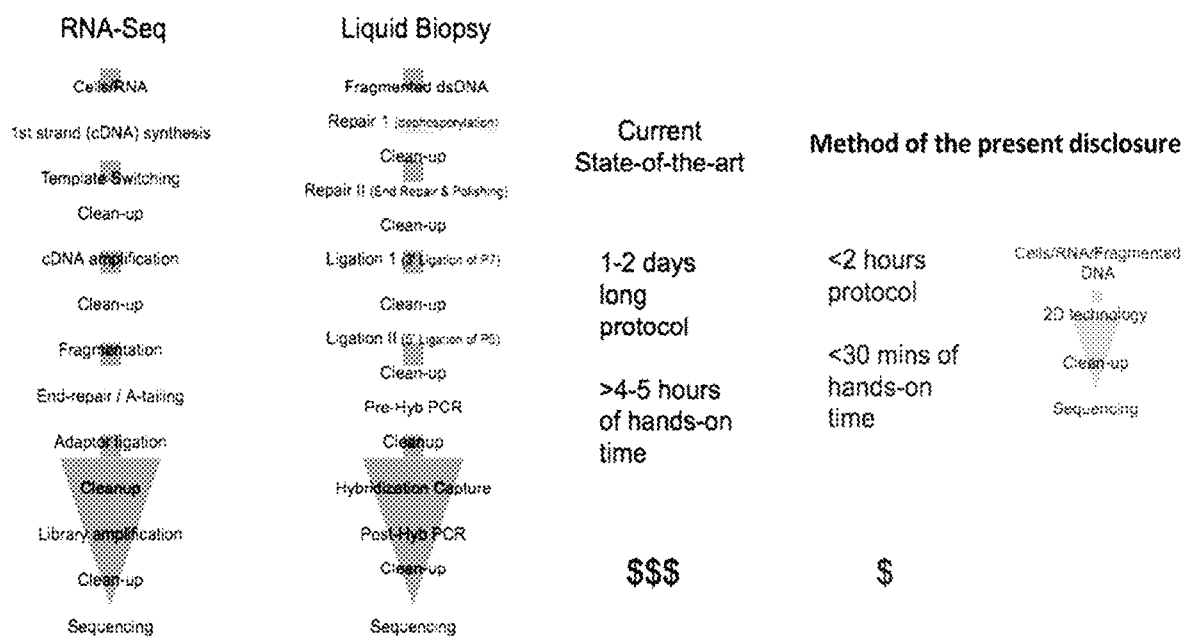
FIG. 1 illustrates a difference between preparing a complementary deoxyribonucleic acid (cDNA) library between a traditional method and the method of the present disclosure.

While various embodiments of the disclosure have been shown and described herein, it will be obvious to those skilled in the art that such embodiments are provided by way of example only. Numerous variations, changes, and substitutions may occur to those skilled in the art without departing from the disclosure. It should be understood that various alternatives to the embodiments of the disclosure described herein may be employed.

Unless defined otherwise, all technical and scientific terms used herein have the same meaning as commonly understood by one of ordinary skill in the art to which the present disclosure belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference, unless only specific sections of patents or patent publications are indicated to be incorporated by reference. In order to further define the present disclosure, the following terms, abbreviations and definitions are provided.

As used herein, the term "about" refers to variations in the numerical quantity that may occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In some embodiments, the term "about" means within 10% of the reported numerical value, or within 5% of the reported numerical value, or within 20% of the reported numerical value.

The indefinite articles "a" and "an" preceding an element or component of the present disclosure are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The terms "anneal". "hybridize" or "bind," can be used interchangeably herein to refer to the combining of one or more single-stranded polynucleotide sequences, segments or strands, and allowing them to form a double-stranded molecule through base pairing. Two complementary sequences (e.g., ribonucleic acid (RNA) and/or deoxyribonucleic acid (DNA)) can anneal or hybridize by forming hydrogen bonds with complementary bases to produce a double-stranded polynucleotide or a double-stranded region of a polynucleotide.

The term "subject" can be any animal which may benefit from the methods of the disclosure, including, e.g., humans and non-human mammals, such as primates, rodents, horses, dogs and cats. Subjects include without limitation a eukaryotic organism, a mammal such as a primate, e.g., chimpanzee or human, cow; dog; cat, a rodent, e.g., guinea pig, rat, mouse; rabbit; or a bird; reptile; or fish. Subjects specifically intended for treatment using the methods described herein include humans. A subject may be an individual or a patient.

As used herein, the term "primer extension reaction" generally refers to the denaturing of a double-stranded nucleic acid, binding of a primer to one or both strands of the denatured nucleic acid, followed by elongation of the primer(s).

As used herein, the term "reaction mixture" generally refers to a composition comprising reagents necessary to complete nucleic acid amplification (e.g., DNA amplification, RNA amplification), with non-limiting examples of such reagents that include primer sets having specificity for target RNA or target DNA, DNA produced from reverse transcription of RNA, a DNA polymerase, a reverse transcriptase (e.g., for reverse transcription of RNA), suitable buffers (including zwitterionic buffers), co-factors (e.g., divalent and monovalent cations), dNTPs, and other enzymes (e.g., uracil-DNA glycosylase (UNG)), etc). In some cases, reaction mixtures can also comprise one or more reporter agents.

As used herein, a "reporter agent" generally refers to a composition that yields a detectable signal, the presence or absence of which can be used to detect the presence of amplified product.

As used herein, the term "target nucleic acid" generally refers to a nucleic acid molecule in a starting population of nucleic acid molecules having a nucleotide sequence whose presence, amount, and/or sequence, or changes in one or more of these, are desired to be determined. A target nucleic acid may be any type of nucleic acid, including DNA. RNA, and analogues thereof.

The term "primer", as used herein, refers to an oligonucleotide, occurring naturally as in a purified restriction digest or produced synthetically that is characterized by an ability to be extended against a template oligonucleotide, so that an oligonucleotide whose sequence is complementary to that of at least a portion of the template molecule is linked to the primer, when all ar placed in the presence of nucleotides at a suitable temperature and pH. However, the mere ability to be used in this fashion does not require that primers be fully extended against a template, and in some embodiments, primers are used only as a site for the addition of a small number of non-templated nucleotides. Primers such as primer hexamers having a length of at least 6 nucleotides long can be used. In some embodiments, a primer may be fluorescently labeled (e.g., 5'-/56FAM/TGATGACGAGG-CATTTGGC/3'). In some embodiments, primers have a length within the range of about 6 to about 100 nucleotides, or in some embodiments from about 10 to about 70 nucleotides. In some embodiments, larger primers can be used. In some embodiments, random primers may be used. In some embodiments, a primer may be a random primer. In some embodiments, one or more primer(s) may be one or more random primer(s).

The term "one or more primer(s)" can comprise any number of primers or random primers. For example, "one or more primer(s)" can include at least, at most, or about 1, 2, 3, 4, 5, 6, 7, 8, 9, 10, 11, 12, 13, 14, 15, 16, 17, 18, 19, 20, 21, 22, 23, 24, 25, 26, 27, 28.29, 20, 31, 32, 33.34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 primers or random primers. One or more primer(s) can include about 1 to about 2, about 1 to about 3, about 1 to about 4, about 1 to about 5, about 1 to about 6, about 1 to about 7, about 1 to about 8, about 1 to about 9, about 1 to about 10, about 1 to about 15, about 1 to about 20, about 1 to about 25, about 1 to about 30, about 1 to about 35, about 5 to about 15, about 3 to about 10, about 5 to about 20, about 10 to about 50, about 30 to about 100, or more than about 100 primers. One or more primer(s) can comprise any number of primers. For example, one or more primer(s) can include at least, at most, or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 20, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 150, 200, 250, 300, 350, 400, 450, 500, 550, 600, 700, 800, 900, 1000, 1100, 1200, 1300, 1400, 1500, 1600, 1700, 1800, 1900, 2000, 3000, 4000, 5000, 6000, 7000, 8000, 9000, 10000, 11000, 12000, 13000, 14000, 15000, 16000, 17000, 18000, 19000, 20000, 25000, 30000, 35000, 40000, 45000, 50000, 55000, 60000, 65000, 70000, 75000, 80000, 85000, 90000, 95000, 100000, 150000, 200000, 250000, 300000, 350000, 400000, 450000, 500000, 550000, 600000, 650000, 700000, 750000, 800000, 850000, 900000, 950000, 1000000, 1500000, 2000000, 2500000, 3000000, 3500000, 4000000, 4500000, 5000000, 5500000, 6000000, 6500000, 7000000, 7500000, 8000000, 8500000, 9000000, 9500000, or 10000000 primers. One or more primer(s) can include about 10 to about 100, about 100 to about 1000, about 1000 to about 10,000, about 10,000 to about 100,000, about 100.000 to about 1,000,000, or about 1,000,000 to about 10,000,000 primers.

The term "random primer," as used herein, refers to a primer containing a random base sequence therein, and is intended to encompass primers whether they consist partially or wholly of random base sequences.

In some embodiments, a primer may comprise an adaptor sequence. In some embodiments, the 5' tail sequence of a primer comprises a sequence which does not hybridize to a target (the adaptor sequence). The adaptor sequence may be selected such that it is the same in a variety of primers which have different 3' target binding sequences (i.e., a "universal" 5' tail sequence). This allows a single reporter probe sequence to be used for detection of any desired target sequence, which is an advantage in that synthesis of the reporter probe is more complex due to the labeling. In some embodiments, a primer may comprise an RNA primer. In some embodiments, a primer may comprise a DNA primer. In some embodiments, a primer may comprise an R2 RNA primer. In some embodiments, a primer may comprise one or more random primer(s).

As used herein, the term "acceptor template" is synonymous to "acceptor nucleic acid molecule." In some embodiments, an acceptor nucleic acid may be modified. In some embodiments, an acceptor nucleic acid molecule may be modified at the 3' end, for example to protect it from being mistaken as an RNA primer. In some embodiments, the modification of the acceptor nucleic acid molecule may comprise a dideoxy 3' end. In some embodiments, the modification may comprise a phosphorylated 3' end. In some embodiments, the phosphorylated 3' end of a polynucleotide or of an acceptor nucleic acid molecule, which typically has a hydroxyl group on its 3' end, can act as a 3' block because extension by an enzyme of the present disclosure, or of DNA polymerase for example may be inhibited or ligation by a ligase may be inhibited. Another non-limiting example of a 3' block includes the addition of a 3' C3 spacer (three-carbon spacer) to the 3' end of a polynucleotide which can function as an effective blocking agent against polymerase extension. Zhou, et al., Clin. Chem., 50: 1328-1335 (2004). Thus, the 3' end can be blocked by the addition of, for example, a C3 spacer, a phosphate, an amine group (NH2), or any other chemical modification that inhibits formation of a subsequent phosphodiester bond between the 3' end of the polynucleotide and another nucleotide.

An "overhang sequence," as used herein, refers to a single stranded region of nucleic acid extending from a double stranded region.

An "isolated" polynucleotide, as used herein, means a polynucleotide that has been either removed from its natural environment, produced using recombinant techniques, or chemically or enzymatically synthesized. A polynucleotide can also be purified, i.e., essentially free from any other polynucleotides and associated cellular products or other impurities.

The term "polymerase" as used herein can refer to an enzyme that links individual nucleotides together into a strand, using another strand as a template. In some embodiments, the polymerase is a polymerase with editing capabilities. In some embodiments, the polymerase with editing capabilities may be 3' to 5' exonuclease, T4 DNA polymerase, exonuclease I, Phi29, Pfu, Vent, KOD, exonuclease III, and exonuclease T. Examples of polymerases can include a DNA polymerase, an RNA polymerase, an RNA-directed DNA polymerase, reverse transcriptase, a polypeptide having reverse transcriptase activity, or any variant thereof, a thermostable polymerase, a wild-type polymerase, a modified polymerase. E. coli DNA polymerase I, T7 DNA polymerase, bacteriophage T4 DNA polymerase PHI 29 (phi29) DNA polymerase, Taq polymerase, Tth polymerase, Tli polymerase, Pfu polymerase VENT polymerase, DEEP-VENT polymerase, EX-Taq polymerase, LA-Taq polymerase, Sso polymerase, Poc polymerase, Pab polymerase, Mth polymerase, ES4 polymerase, Tru polymerase, Tac polymerase, Tne polymerase, Tma polymerase, Tea polymerase, Tih polymerase, Tfi polymerase, Platinum Taq polymerases, Tbr polymerase, Tfl polymerase, Tth polymerase, Pfutubo polymerase, Pyrobest polymerase, Pwo polymerase, KOD polymerase, Bst polymerase, Sac polymerase, Klenow fragment, polymerase with 3' to 5' exonuclease activity, and variants, modified products and derivatives thereof. In some embodiments, the polymerase may be a reverse transcriptase or a modified reverse transcriptase of the present disclosure. In some embodiments, the polymerase is a single subunit polymerase. The polymerase can have high processivity, namely the capability of the polymerase to consecutively incorporate nucleotides into a nucleic acid template without releasing the nucleic acid template.

The term "reverse transcriptase" or RT refers to an enzyme with both an RNA-directed DNA polymerase and a DNA-directed DNA polymerase. RT refers to a group of enzymes having reverse transcriptase activity (e.g., that catalyze synthesis of DNA from an RNA template). In general, such enzymes include, but are not limited to, retroviral reverse transcriptase, retrotransposon reverse transcriptase, retroplasmid reverse transcriptases, retron reverse transcriptases, bacterial reverse transcriptases, group II intron-derived reverse transcriptase, and mutants, variants or derivatives thereof. Non-retroviral reverse transcriptases include non-long terminal repeat (LTR) retrotransposon reverse transcriptases, retroplasmid reverse transcriptases, retron reverse transciptases, and group 11 intron reverse transcriptases. Further bacterial reverse transcriptases are described by Simon D & Zimmerly S (2008) "A diversity of uncharacterized retroelements in bacteria" Nucleic Acids Res 36(22):7219-7229., and Kojima, K K & Kanehisa, M (2008) "Systematic survey for novel types of prokaryotic retroelements based on gene neighborhood and protein architecture" Mol Biol Evol 25:1395-1404, which describe many classes of non-retroviral reverse transcriptases (i.e., retrons, group II introns, and diversity-generating retroelements among others). Reverse transcriptase has been used primarily to transcribe RNA into cDNA, which can then be cloned into a vector for further manipulation or used in various amplification methods such as polymerase chain reaction, nucleic acid sequence-based amplification (NASBA), transcription mediated amplification (TMA), self-sustained sequence replication (3SR), diverse primer extension reactions, 5'RACE, detection of chemical modifications or other techniques that require synthesis of DNA using an RNA template.

Retroviral Reverse Transcriptase Enzymes

Moloney Murine Leukemia Virus (M-MLV) reverse transcriptase contains a single subunit of 78 kDa with RNA-dependent DNA polymerase and RNase H activity. This enzyme has been cloned and expressed in a fully active form in *E. coli* (reviewed in Prasad, V. R., Reverse Transcriptase, Cold Spring Harbor, N.Y.: Cold Spring Harbor Laboratory Press, p. 135 (1993)).

Human Immunodeficiency Virus (HIV) reverse transcriptase is a heterodimer of p66 and p5 subunits in which the smaller subunit is derived from the larger subunit by proteolytic cleavage. The p66 subunit has both a RNA-dependent DNA polymerase and an RNase H domain, while the p51 subunit has only a DNA polymerase domain. Active HIV p66/p51 reverse transcriptase has also been cloned and expressed successfully in a number of expression hosts, including *E. coli* (reviewed in Le Grice, S. F. J., Reverse Transcriptase, Cold Spring Harbor, N.Y.: Cold Spring Harbor Laboratory press, p. 163 (1993)). Within the HIV p66/p51 heterodimer, the 51-kD subunit is catalytically inactive, and the 66-kD subunit has both DNA polymerase and RNase H activity (Le Grice, S. F. J., et al., EMBO Journal 10:3905 (1991): Hostomsky, Z., et al., J. Virol. 66:3179 (1992)).

Members of the Avian Sarcoma-Leukosis Virus (ASLV) reverse transcriptase family are also a heterodimers of two subunits, alpha (approximately 62 kDa) and beta (approximately 94 kDa), in which the alpha subunit is derived from the beta subunit by protcolytic cleavage (reviewed in Prasad, V. R., Reverse Transcriptase, Cold Spring Harbor, N.Y.: Cold Spring Harbor Laboratory Press (1993), p. 135). Members of this family include, but are not limited to, Rous Sarcoma Virus (RSV) reverse transcriptase, Avian Myeloblastosis Virus (AMV) reverse transcriptase, Avian Erythroblastosis Virus (AEV) Helper Virus MCAV reverse transcriptase, Avian Myelocytomatosis Virus MC29 Helper Virus MCAV reverse transcriptase, Avian Reticuloendotheliosis Virus (REV-T) Helper Virus REV-A reverse transcriptase, Avian Sarcoma Virus UR2Helper Virus UR2AV reverse transcriptase, Avian Sarcoma Virus Y73 Helper Virus YAV reverse transcriptase, Rous Associated Virus (RAV) reverse transcriptase, and Myeloblastosis Associated Virus (MAV) reverse transcriptase, among others.

ASLV reverse transcriptase can exist in two additional catalytically active structural forms, Ad and a (Hizi, A. and Joklik, W. K., J. Biol. Chem. 252: 2281 (1977)).

Sedimentation analysis suggests the presence of alpha/beta and beta/beta are dimers and that the a form exists in an equilibrium between monomeric and dimeric forms (Grandgenett, D. P., et al., Proc. Nat. Acad. Sci. USA 70:230 (1973); Hizi, A. and Joklik, W. K., J. Biol. Chem. 252:2281 (1977); and Soltis, D. A. and Skalka, A. M., Proc. Nat. Acad. Sci. USA 85:3372 (1988)). The ASLV alpha/beta and beta/beta reverse transcriptases are the only known examples of retroviral reverse transcriptase that include three different activities in the same protein complex: DNA polymerase, RNase H, and DNA endonuclease (integrase) activities (reviewed in Skalka, A. M., Reverse Transcriptase, Cold Spring Harbor, N.Y.: Cold Spring Harbor Laboratory Press (1993), p. 193). The a form lacks the integrase domain and activity.

Various forms of the individual subunits of ASLV reverse transcriptase have been cloned and expressed. These include a 98-kDa precursor polypeptide that is normally processed proteolytically to beta and a 4 kDa polypeptide removed from the beta carboxy end (Alexander, F., et al., J. Virol. 61:534 (1987) and Anderson, D. et al., Focus 17:53 (1995)), and the mature beta subunit (Weis, J. H. and Salstrom, J. S., U.S. Pat. No. 4,663,290 (1987); and Soltis, D. A. and Skalka, A. M., Proc. Nat. Acad. Sci. USA 85:3372 (1988)). (See also Werner S, and Wohrl B. M., Eur. J. Biochem. 267:47404744 (2000); Werner S, and Wohrl B. M., J. Virol. 74:3245-3252 (2000); Werner S, and Wohrl B. M., J. Biol. Chem. 274: 26329-26336 (1999).) Heterodimeric RSV alpha/beta reverse transcriptase has also been purified from *E. coli* cells expressing a cloned RSV beta gene (Chemov, A. P., et al., Biomed. Sci. 2:49 (1991)).

Reverse Transcriptases of Non-Retroviral Origin

Reverse transcriptase enzymes may also be isolated from a large number of mobile genetic elements which are not of retroviral origin. Such mobile genetic elements are resident in the genomes of higher order species and play a function role in life cycle of these mobile genetic elements. Mobile genetic elements are known to encode genes for reverse transcriptase enzymes (reviewed in Howard M Temin, Reverse Transcription in the Eukaryotic Genome: Retroviruses. Pararetroviruses, Retrotransposons, and Retrotranscripts, Mol. Biol. Evol. 2(6):455-468). These elements include, but are not limited, to retrotransposons. Retrotransposons include the non-long terminal repeat (LTR) retrotransposon and LTR mobile elements (e.g., TY3, TY5, non-LTR, LINE-L1, R2, R1). (Reviewed by Cordaux and Batzer. Nature Reviews, October 2009, volume 10, pp 691-703.).

As used herein, "non-LTR retrotransposon" refers to naturally occurring proteins encoded by non-LTR retrotransposons and polypeptide fragments thereof which possess reverse transcriptase activity, as well as proteins or polypeptides derived therefrom which contain one or more amino acid substitutions that either enhance the reverse transcriptase activity thereof or have no deleterious effect thereon. A preferred class of non-LTR retrotransposon are R2 proteins or polypeptides. Thus, as used herein, "R2 protein or R2 enzyme or polypeptide or a functional fragment thereof" refers to naturally occurring proteins encoded by R2 elements and polypeptide fragments thereof which possess reverse transcriptase activity, as well as proteins or polypeptides derived therefrom which contain one or more amino acid substitutions that either enhance the reverse transcriptase activity thereof or have no deleterious effect thereon.

Retroelements, genetic elements that encode RTs, are divided into two major families denoted LTR-containing retroelements and non-LTR-containing retroelements (Xiong Y, Eickbush TH (1990) "Origin and evolution of retroelements based upon their reverse transcriptase sequences" EMBO J 9:3353-62). Non-LTR-retroelements are a diverse family of RT-encoding elements that includes retroplasmids, non-LTR-rtrotransposons, retrons, and mobile group II introns.

As used herein, the term polymerase "active fraction" is defined as a fraction of enzyme with polymerase activity. For example, a reverse transcriptase active fraction (RT active fraction) is a fraction of enzyme that has a reverse transcriptase activity.

As used herein, the terms "variant," "modified," "non-naturally occurring," and "mutant" are synonymous and refer to a polypeptide or enzyme differing from a specifically recited polypeptide or enzyme by one or more amino acid insertions, deletions, mutations, and substitutions, created using, e.g., recombinant DNA techniques, such as mutagenesis. Guidance in determining which amino acid residues may be replaced, added, or deleted without abolishing activities of interest, may be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences. In some embodiments, the terms "derivative," "variant," "modified," "non-naturally occurring," and "mutant" are used interchangeably.

The mutants of the present disclosure may be generated in accordance with any suitable method, including, but not limited to, methods described and exemplified herein. Mutations, such as substitutions, insertions, deletions, and/or side chain modifications, may be introduced into the nucleotide and amino acid sequences of the gene of interest using any suitable technique, including site-directed mutagenesis (Wu, ed., Meth. Enzymol. 217, Academic Press (1993)). The lambda red recombinase method may be used to "knock out" genes (Datsenko et al., PNAS USA 97: 6640-6645 (2000)). Permanent, marker-free, multiple gene disruptions may be created. Non-naturally occurring nucleotides and amino acids also may be used.

As used herein, "homologue" refers to a protein that is functionally equivalent i.e. has the same enzymatic activity as an enzyme having an amino acid sequence of the specified sequence identification number, but may have a limited number of amino acid substitutions, deletions, insertions or additions in the amino acid sequence. In order to maintain the function of the protein, the substitutions may be conservative substitutions, replacing an amino acid with one having similar properties.

In some embodiments, a homologue refers to a protein which has an identity of at least about 25%, at least about 50%, at least about 60%, at least about 70%, at least about 80%, at least about 85%, at least about 90%, at least about 95% or at least about 99% with the amino acid sequence of SEQ ID NO corresponding to the protein. Algorithms for determining sequence identity include e.g. BLAST available through the National Center for Biotechnology Information (NCBI). Sequences may be determined to be similar to a degree that indicates homology and thus similar or identical function.

A polynucleotide encoding a homologue of each enzyme may be obtained by appropriately introducing substitution, deletion, insertion, and/or addition to the DNA of the enzyme which is composed of a nucleotide sequence disclosed herein, using methods such as random mutagenesis and site-specific mutagenesis (Nucleic Acid Res. 10, pp. 6487 (1982), Methods in Enzymol. 100, pp. 448 (1983), Molecular Cloning 2nd Edt., Cold Spring Harbor Laboratory Press (1989), PCR A Practical Approach IRL Press pp. 200 (1991)). The polynucleotide encoding a homologue of each enzyme may be introduced and expressed in a host to obtain the homologue.

The term "heterologous" refers to a molecule or activity derived from a source other than the referenced species whereas "homologous" refers to a molecule or activity derived from the host microbial organism. Accordingly, exogenous expression of an encoding nucleic acid of the present disclosure may use either or both a heterologous or homologous encoding nucleic acid.

In some embodiments, a host cell may be selected from, and the modified or non-naturally occurring enzyme generated in, for example, bacteria, yeast, fungus or any of a variety of other organisms may be used as a host organism.

In some embodiments, the host is not particularly restricted and the enzymatic activity or activities may be incorporated into any suitable host organism using methods, for example, as described herein. In some embodiments, the host is selected from bacteria, yeast, algae, cyanobacteria, fungi, or a plant cell, or any combination thereof. *E. coli* and *S. cerevisiae* are particularly useful host organisms since they are well characterized microorganisms suitable for genetic engineering.

As used herein, "enzyme" includes proteins produced by a cell capable of catalyzing biochemical reactions. Further, unless context dictates otherwise, as used herein "enzyme" includes protein fragments that retain the relevant catalytic activity, and may include artificial enzymes synthesized to retain the relevant catalytic activity.

Each of the enzymes described herein may be attached to an additional amino acid sequence as long as it retains an activity functionally equivalent to that of the enzyme. As mentioned above, it is understood that each enzyme or a homologue thereof may be a (poly)peptide fragment as long as it retains an activity functionally equivalent to that of the enzyme.

In some embodiments, the enzymes for use in compositions, methods and kits of the present disclosure include any enzyme having reverse transcriptase activity. Such enzymes include, but are not limited to, non-retroviral reverse transcriptases, retroviral reverse transcriptases, retrotransposon reverse transcriptases, non-LTR retrotransposons, R2 reverse transcriptases, LTR-retrotransposons, hepatitis B reverse transcriptases, cauliflower mosaic virus reverse transcriptases, bacterial reverse transcriptases, Tth DNA polymerases, Taq DNA polymerases (Saiki, R. K., et al. Science 239:487-491 (1988); U.S. Pat. Nos. 4,889,818 and 4,965,188), Tne DNA polymerases (PCT Publication No. WO 96/10640), Tma DNA polymerases (U.S. Pat. No. 5,374,553) and mutants, fragments, variants or derivatives thereof. In some embodiments, reverse transcriptases for use in the present disclosure include retroviral reverse transcriptases such as M-MLV reverse transcriptase, AMV reverse transcriptase, RSV reverse transcriptase, RAV reverse transcriptase. MAV reverse transcriptase, and generally ASLV reverse transcriptases. Mutant reverse transcriptases can, for example, be obtained by mutating the gene or genes encoding the reverse transcriptase of interest by site-directed or random mutagenesis. Such mutations may include point mutations, deletion mutations, insertional mutations, and truncations. For example, one or more point mutations (e.g., substitution of one or more amino acids with one or more different amino acids) may be used to construct mutant reverse transcriptases for use in the present disclosure.

In some embodiments, the enzyme is selected and/or engineered to exhibit high fidelity with low error rates. The fidelity of a nucleotide polymerase is typically measured as the error rate, i.e., the frequency of incorporation of a nucleotide in a manner that violates the widely known Watson-Crick base pairing rules. The fidelity or error rate of a polymerase (e.g., DNA polymerase) may be measured using any suitable assay. See, for example, Lundburg et al., 1991 Gene, 108:1-6. The term "fidelity" can be used to refer to the accuracy of polymerization, or the ability of the polymerase to discriminate correct from incorrect substrates, (e.g., nucleotides) when synthesizing nucleic acid molecules (e.g. RNA or DNA) which are complementary to a template. The higher the fidelity of an enzyme, the less the enzyme misincorporates nucleotides in the growing strand during nucleic acid synthesis; that is, an increase or enhancement in fidelity results in a more faithful polymerase having decreased error rate (decreased misincorporation rate). In some embodiments, the misincorporation error rate is at most about 10-2, 10-4, 10-6, or 10-8.

In some embodiments, the non-naturally occurring or modified enzyme (e.g., non-naturally occurring or modified reverse transcriptase, non-naturally occurring or modified non-LTR retrotransposon, non-naturally occurring or modified R2 reverse transcriptase) or a modified polypeptide having reverse transcriptase activity exhibits a misincorporation error rate of equal to or less than about 50%, equal to or less than about 45%, equal to or less than about 40%, equal to or less than about 35%, equal to or less than about 30%, equal to or less than about 25%, equal to or less than about 20%, equal to or less than about 15%, equal to or less than about 10%, equal to or less than about 9%, equal to or less than about 8%, equal to or less than about 7%, equal to or less than about 6%, equal to or less than about 5%, equal to or less than about 4%, equal to or less than about 3%, equal to or less than about 2%, equal to or less than about 1%, equal to or less than about 0.01%, equal to or less than about 0.001%, equal to or less than about 0.0001%, equal to or less than about 0.00001%, equal to or less than about 0.000001%, or equal to or less than about 0.0000001%.

In some embodiments, the non-naturally occurring or modified enzyme (e.g., non-naturally occurring or modified reverse transcriptase, non-naturally occurring or modified non-LTR retrotransposon, non-naturally occurring or modified R2 reverse transcriptase) or a modified polypeptide having reverse transcriptase activity generates one or more nucleic acid (e.g., cDNA) molecule(s) complementary to a template at an error rate that is at least about 10000 times lower, at least about 1500 times lower, at least about 1000 times lower, at least about 500 times lower, at least about 100 times lower, at least about 95 times lower, at least about 90 times lower, at least about 85 times lower, at least about 80 times lower, at least about 75 times lower, at least about 70 times lower, at least about 65 times lower, at least about 60 times lower, at least about 55 times lower, at least about 50 times lower, at least about 45 times lower, at least about 40 times lower, at least about 35 times lower, at least about 30 times lower, at least about 25 times lower, at least about 20 times lower, at least about 15 times lower, at least about 10 times lower, at least about 9 times lower, at least about 8 times lower, at least about 7 times lower, at least about 6 times lower, at least about 5 times lower, at least about 4 times lower, at least about 3 times lower, at least about 2 times lower, or at least about 1 time lower than the unmodified or naturally occurring enzyme or unmodified polypeptide having reverse transcriptase activity.

In some embodiments, the sequencing error rate will be equal to or less than about 1 in 100,000 bases. In some embodiments, the error rate of nucleotide sequence determination is equal to or less than about 1 in 10 bases, 1 in 20 bases, 3 in 100 bases, 1 in 100 bases, 1 in 1000 bases, and 1 in 10,000 bases.

The terms "polynucleotides", "nucleic acid", "nucleotides" and "oligonucleotides" can be used interchangeably. They can refer to a polymeric form of nucleotides of any length, either deoxyribonucleotides or ribonucleotides, fragments, or analogs thereof. The following are non-limiting examples of polynucleotides: coding or non-coding regions of a gene or gene fragment, loci (locus) defined from linkage analysis, exons, introns, messenger RNA (mRNA), transfer RNA, transfer-messenger RNA, ribosomal RNA, antisense RNA, small nuclear RNA (snRNA), small nucleolar RNA (snoRNA), micro-RNA (miRNA), small interfering RNA (siRNA), ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. A nucleic acid described herein can contain phosphodiester bonds. In some embodiments, the nucleic acids can be DNA (including, e.g., genomic DNA, mitochondrial DNA, and cDNA), RNA (including, e.g., mRNA and rRNA) or a hybrid, where the nucleic acid contains any combination of deoxyribo- and ribo-nucleotides, and any combination of bases, including uracil, adenine, thymine, cytosine, guanine, inosine, xathanine hypoxathanine, isocytosine, isoguanine, etc. A polynucleotide is intended to encompass a singular nucleic acid as well as plural nucleic acids The polynucleotide may be composed of any polyribonucleotide or polydeoxyribonucleotide, which may be unmodified RNA or DNA or modified RNA or DNA. For example, polynucleotides may be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions.

Ribosomal RNAs can make up as much as 80% or more of the total RNA in a sample. It is often desirable to separate mRNA from rRNA because rRNA can adversely affect the quantitative analysis of mRNA. One approach to separating rRNA from mRNA is to deplete the rRNA from the sample. One example, is the hybridization of rRNA molecules using oligonucleotides, for example, oligonucleotides homologous to the 17S rRNA, 18S rRNA, or 28S rRNA in the case of eukaryotic rRNAs, or to the 16S rRNA or 23S rRNA in the case of bacterial rRNA. The oligonucleotides are designed such that they can be "captured" and the hybridization product removed from the sample. For example, the oligonucleotides may be immobilized on a surface such as a column or a bead. MICROBExpress (Registered Trademark) and MICROBEnrich (Registered Trademark) (Ambion, Austin, Tex.) are examples of commercially available kits for the depletion of rRNA. Methods and compositions for the depletion or rRNA from a sample are described in U.S. application Ser. No. 10/029,397, which is incorporated by reference. The poly(A) tail at the 3' end of most eukaryotic mRNAs can be used to separate these molecules away from rRNA and other non-mRNA species that lack this poly(A) tail. In some embodiments, the method of the present disclosure comprises depleting ribosomal RNA, such as by hybridization of an oligonucleotide to an rRNA. In some embodiments, the method of the present disclosure comprises depleting rRNA and/or tRNA by oligonucleotide probe-guided endonucleolitic cleavage of at least one rRNA and/or tRNA sequence. In some embodiments, depletion can be partial or a complete depletion. In some embodiments, depletion comprises decreasing the number of rRNA and/or tRNA from a sample. In some embodiments, the present disclosure relates to methods of depleting rRNA and/or transfer RNA (tRNA). In some embodiments, the present disclosure relates to depleting at least one transfer RNA (tRNA) from one or more template nucleic acid molecules. In some embodiments, depleting rRNA and/or tRNA occurs prior to annealing of a primer (e.g., one or more primers) to a template.

In one embodiment, the present disclosure relates to a method of depleting ribosomal and/or transfer RNA from a sample for library sequencing. In some embodiments, the method comprises providing a sample comprising RNA. In some embodiments, the RNA comprises ribosomal RNA (rRNA) and/or transfer RNA (tRNA). In some embodiments, the method comprises performing a polymerase chain reaction (PCR) to convert the rRNA and/or tRNA to double stranded DNA (dsDNA). In some embodiments, the method comprises partial or full (complete) amplification. In some embodiments, the method further comprises introducing a complex comprising a nuclease and/or a polynucleotide encoding a nuclease and at least one specifically designed guide oligonucleotide. In some embodiments, the at least one guide oligonucleotide comprises a sequence complementary to at least one rRNA and/or at least one tRNA. In some embodiments, the at least one guide oligonucleotide comprises at least one sequence complementary to at least one dsDNA. In some embodiments, the nuclease or polynucleotide encoding the nuclease cleaves at least one strand of the dsDNA. In some embodiments, the nuclease or polynucleotide encoding the nuclease cleaves the rRNA and/or the tRNA and/or the dsDNA, thereby depleting the rRNA and/or the tRNA from the sample. In some embodiments, the nuclease is Cas9 or the polynucleotide encodes Cas9 or a functional variant thereof. In some embodiments, the method comprises denaturing the dsDNA into single-stranded DNA (ssDNA) strands. In some embodiments, the method further comprises introducing at least one oligonucleotide (e.g., specifically designed oligonucleotide) comprising a binding molecule and at least one sequence complementary to at least one ssDNA strand to form a hybridized complex of the oligonucleotide and the at least one ssDNA strand. In some embodiments, the method comprises immobilizing the hybridized complex to at least one solid support. In some embodiments, immobilizing the hybridized complex causes the hybridized complex to be removed from a sample. In some embodiments, the solid support comprises streptavidin. In some embodiments, the method comprises introducing at least one oligonucleotide (e.g., specifically designed oligonucleotide) comprising a binding molecule and at least one sequence complementary to at least one rRNA and/or tRNA to form a complex comprising the oligonucleotide and the at least one rRNA and/or tRNA. In some embodiments, the method further comprises immobilizing the complex to at least one solid support. In some embodiments, immobilizing the complex causes the complex to be removed from a sample. In some embodiments, the solid support comprises streptavidin. In some embodiments, the binding molecule is biotin.

In some embodiments, any of the method of the present disclosure comprises a nuclease or polynucleotide encoding the nuclease. In some embodiments, the nuclease or polynucleotide encoding the nuclease cleaves at least one strand of a dsDNA. In some embodiments, cleavage of dsDNA is an intermediate product of library preparation. In some embodiments, cleavage of dsDNA includes rRNA and/or tRNA (coding sequences). In some embodiments, oligo-guided nucleolitic cleavage may not or does not require denaturing dsDNA. In some embodiments, not requiring dsDNA denaturation is a significant improvement of the present disclosure. In some embodiments, the nuclease or a polynucleotide encoding the nuclease is Cas9, or a polynucleotide encoding Cas9, or a functional variant thereof.

In one embodiment, the present disclosure relates to a method comprising adding a nuclease complex to a plurality of double-stranded nucleic acid molecules. In some embodiments, the nuclease complex comprises a Cas9 nuclease or a functional variant thereof and at least one synthetic guide oligonucleotide. In some embodiments, the synthetic guide oligonucleotide is complementary to a ribosomal ribonucleic acid (rRNA) and/or transfer ribonucleic acid (tRNA) region. In some embodiments, the region is in at least one double-stranded nucleic acid molecule. In some embodiments, the method comprises permitting the complex to cleave an rRNA and/or a tRNA region. In some embodiments the region is present in at least one double-stranded nucleic acid molecule. In some embodiments, the method provides at least one cleaved double-stranded nucleic acid molecule. In some embodiments, the method comprises subjecting the at least one cleaved double-stranded nucleic acid molecule or derivative thereof to sequencing (e.g., nucleic acid sequencing). In some embodiments, the method comprises sequencing a nucleic acid sequence of at least one double-stranded nucleic acid molecule lacking an rRNA and/or a tRNA region. In some embodiments, the method comprises sequencing a nucleic acid sequence of at least one double-stranded nucleic acid molecule comprising an rRNA and/or a tRNA region. In some embodiments, the method comprises sequencing a mixture of nucleic acid sequence wherein the mixture comprises at least one double-stranded nucleic acid molecule comprising an rRNA and/or a tRNA region and at least one double-stranded nucleic acid molecule lacking an rRNA and/or a tRNA region.

In one embodiment, the present disclosure relates to a method of producing a cell free deoxyribonucleic acid (cfDNA) library comprising: providing a sample comprising cfDNA; denaturing the cfDNA to produce a single stranded DNA (ssDNA) sample; introducing, in the presence of nucleotides and/or a catalytic metal, a complex comprising a template, a primer, and a reverse transcriptase to the ssDNA sample, wherein the reverse transcriptase extends the primer on the template and subsequently template jumps to the ssDNA sample to produce a double stranded DNA (dsDNA) sample, and wherein the dsDNA comprises at least one nick between the template and the ssDNA; introducing a polymerase comprising a 3'-to-5' exonuclease activity to generate a dsDNA with blunt ends and/or a Y-overhang; introducing an asymmetric adapter comprising a nucleic acid duplex with a single-stranded overhang at the 5' end, wherein the asymmetric adapter is ligated to the 5' end of the dsDNA, and wherein the single-stranded overhang comprises a sequence complementary to at least one polymerase chain reaction (per) amplification primer; and performing a per reaction to amplify only one strand of the dsDNA.

In one embodiment, the present disclosure relates to a method of producing a cell free deoxyribonucleic acid (cfDNA) library. In some embodiments, the method comprises providing a sample comprising cfDNA. In some embodiments, the method comprises denaturing the cfDNA to produce a single stranded DNA (ssDNA) sample. In some embodiments, the method comprises introducing a terminal deoxynucleotidyl transferase (TdT) and a deoxyadenosine triphosphate (dATP) to the ssDNA sample to generate a poly(A) and/or a poly(C) tail. In some embodiments, the method comprises introducing a non-extendable nucleotide. In some embodiments, the method comprises annealing a complex comprising a primer and a first adapter to the tail of the ssDNA sample. In some embodiments, the complex comprises a sequence complementary to the tail. In some embodiments, the method comprises introducing, in the presence of nucleotides and/or a catalytic metal, a reverse transcriptase (e.g., a modified reverse transcriptase) and a complex comprising an acceptor and a second adapter to produce a double strand DNA (dsDNA) sample. In some embodiments, the nucleotides comprise degradable nucleotides. In some embodiments, the reverse transcriptase extends the primer and subsequently template jumps to the complex to continue extension. In some embodiments, the complex comprises a nucleotide block to prevent the reverse transcriptase from reaching the end of the complex and jumping to another complex. In some embodiments, the dsDNA comprises an original strand and a copy strand. In some embodiments, the original strand comprises at least one nick between the complex and the ssDNA. In some embodiments, the copy strand comprises at least one degradable nucleotide. In some embodiments, the method further comprises introducing a polymerase comprising a 3'-to-5' exonuclease activity to generate a dsDNA with blunt ends or a 3'-overhang, and/or a DNA ligase to ligate the at least one nick. In some embodiments, the method further comprises introducing at least one uracil-DNA glycosylase to degrade at least one degradable nucleotide. In some embodiments, the method further comprises performing a polymerase chain reaction (PCR) comprising a primer (e.g., at least a first primer and/or at least a first and a second primer) to amplify the original strand. In some embodiments, the primer (e.g., the first primer) comprises a sequence complementary to the first adapter and the second primer comprises a sequence complementary to the second adapater.

In one embodiment, the present disclosure relates to a method of producing a library for sequencing. In some embodiments, the method comprises providing a sample comprising cell free ribonucleic acid (cfRNA). In some embodiments, the method comprises subjecting the sample to high temperature. In some embodiments, the high temperature is sufficient to allow for transphosphorylation of the RNA (e.g., cfRNA). In some embodiments, the method further comprises introducing a phosphatase. In some embodiments, the phosphatase can convert a phosphate moiety of an RNA to a 3'-hydroxyl group. In some embodiments, the method further comprises introducing an adenosine triphosphate and a polymerase to generate a poly(A) tail on the 3'-hydroxyl group of the RNA. In some embodiments, the method further comprises introducing, in the presence of nucleotides, a primer, an acceptor, and a reverse transcriptase. In some embodiments, the primer comprises a sequence complementary to the poly(A) tail thereby annealing to the poly(A) tail. In some embodiments, the reverse transcriptase extends the primer and subsequently template jumps to the acceptor to continue extension. In some embodiments, the method further comprises introducing at least one solid support to immobilize excess primer and non-specific primer products to the at least one solid support, thereby removing the excess primer and the non-specific primer products from the sample. In some embodiments, the method further comprises performing a polymerase chain reaction (PCR) reaction to amplify the RNA. In some embodiments, the method further comprises using an isothermal amplification reaction.

In one embodiment, the present disclosure relates to a method for preparing a nucleic acid library for sequencing. In some embodiments, the method comprises obtaining a plurality of nucleic acid molecules. In some embodiments, the method comprises inducing a non-enzymatic intramolecular transphosphorylation of at least one nucleic acid molecule (e.g., in the plurality of nucleic acid molecules). In some embodiments, the non-enzymatic intramolecular transphosphorylation can occur by increasing temperature (e.g., increase the temperature of a plurality of nucleic acid molecules). In some embodiments, non-enzymatic intramolecular transphosphorylation and/or an increase of temperature results in a nucleic acid molecule having a free 5'-phosphate moiety (e.g., a plurality of nucleic acid molecules can have a free 5'-phosphate moiety). In some embodiments, the method comprises adding a phosphatase to the nucleic acid molecules with the free 5'-phosphate moiety. In some embodiments, the phosphatase converts one or more of the free 5'-phosphate moieties to a hydroxyl group. In some embodiments, this results in a plurality of nucleic acid molecules to have a free hydroxyl group. In some embodiments, the method comprises mixing (e.g., in the presence of an amount of adenosine triphosphates) a plurality of nucleic acid molecules and a polymerase. In some embodiments, the polymerase generates a poly(A) tail on the free hydroxyl group. In some embodiments, the method comprises mixing, in the presence of nucleotides, (i) one or more primers comprising a sequence complementary to said poly(A) tail; (ii) one or more acceptor nucleic acid molecules; and (iii) a modified reverse transcriptase. In some embodiments, the modified reverse transcriptase generates a plurality of continuous complementary deoxyribonucleic acid molecule by reverse transcribing a sequence of an annealed template nucleic acid molecule, migrating to an acceptor nucleic acid molecule, and reverse transcribing a sequence of said acceptor nucleic acid molecule. In some embodiments, the method comprises adding at least one solid support. In some embodiments, the solid support immobilizes an excess of the one or more primers comprising a sequence complementary to said poly(A) tail. In some embodiments, the method comprises performing a polymerase chain reaction (PCR) reaction. In some embodiments, the method comprises performing an isothermal amplification.

In one embodiment, the present disclosure relates to a method of producing a library for sequencing. In some embodiments, the method comprises providing a sample comprising at least one nucleic acid molecule (such as ribonucleic acid (e.g., cfRNA)). In some embodiments, the method comprises subjecting the sample (or the nucleic acid molecule) to high temperature sufficient to allow for transphosphorylation of the nucleic acid molecule (e.g., RNA). In some embodiments, the method further comprises adding a catalytic metal (e.g., magnesium) and/or a polyamine. In some embodiments, the method comprises introducing a phosphatase to convert a phosphate moiety of a nucleic acid molecule (e.g., RNA) to a 3'-hydroxyl group. In some embodiments, the method comprises introducing an adenosine triphosphate and a polymerase to generate a poly(A) tail. In some embodiments, the poly(A) tail is generated on the 3'-hydroxyl group of the nucleic acid molecule (e.g., RNA). In some embodiments, the method comprises introducing, in the presence of nucleotides, a primer, an acceptor, and a reverse transcriptase to the sample or to the nucleic acid molecule. In some embodiments, the primer comprises a sequence complementary to the poly(A) tail thereby annealing to the poly(A) tail. In some embodiments, the reverse transcriptase extends the primer and subsequently template jumps to the acceptor to continue extension. In some embodiments, the method comprises introducing at least one solid support. In some embodiments, the solid support immobilizes excess primer and non-specific primer products. In some embodiments, the excess primer and the non-specific primer products is removed from the sample/mixture. In some embodiments, the method further comprises performing a polymerase chain reaction (PCR) reaction to amplify the nucleic acid molecule (e.g., RNA). In some embodiments, the method further comprises an isothermal amplification reaction.

In one embodiment, the present disclosure relates to a method of depleting rRNA and/or tRNA and/or to a method comprising reverse transcribing at least one nucleic acid molecule by performing an amplification reaction. In some embodiments, at least one nucleic acid molecule is rRNA and/or tRNA. In some embodiments, the amplification reaction provides a plurality of double-stranded nucleic acid molecules (e.g., cDNA). In some embodiments, the method comprises adding a nuclease or a polypeptide comprising a nuclease and/or a guide oligonucleotide. In some embodiments, the method comprises adding a complex comprising a nuclease or a polypeptide comprising a nuclease and a guide oligonucleotide. In some embodiments, the nuclease or polypeptide comprising the nuclease is Cas9 or a polypeptide comprising Cas9. In some embodiments, the guide oligonucleotide is complementary to region of a nucleic acid molecule. In some embodiments, the guide oligonucleotide is complementary to a pre-determined region in at least one nucleic acid molecule (e.g., double-stranded nucleic acid molecule). In some embodiments, the oligonucleotide directs the nuclease (e.g., Cas9) to the site of cleavage. In some embodiments, the complex comprising a nuclease and a guide oligonucleotide cleaves a region or a pre-determined region of the nucleic acid molecule. In some embodiments, the cleavage is at a gene. In some embodiments, the method comprises sequencing the cleaved nucleic acid molecules (e.g., cleaved double stranded nucleic acid molecules) (e.g., sequencing a library of cleaved nucleic acid molecules). In some embodiments the double-stranded nucleic acid molecules comprises sequences derived from an rRNA, a tRNA, or both an rRNA and a tRNA. In some embodiments, the pre-determined region of at least one double-stranded nucleic acid molecule is a region of an rRNA, a tRNA, or both (e.g., a combination). In some embodiments, the pre-determined region is a region of an rRNA. In some embodiments, the pre-determined region is a region of a tRNA. In some embodiments the method does not require denaturation of nucleic acid molecules. In some embodiments, the method does not require denaturation of the plurality of double-stranded nucleic acid molecules. In some embodiments, a double-stranded nucleic acid molecule comprises a sequence derived from an rRNAs and/or a tRNA prior to sequencing. In some embodiments, the double-stranded nucleic acid molecules comprise a cDNA.

In one embodiment, the present disclosure relates to a method for preparing a concatemer of nucleic acid molecules. In some embodiments, the method comprises processing ends of a plurality of double-stranded nucleic acid molecules. In some embodiments, the method comprises adding a first plurality of adaptor molecules to the plurality of double stranded nucleic acid molecules. In some embodiments, the first plurality of adaptor molecules comprise one or more overhang sequences. In some embodiments, at least two of the one or more overhang sequences are complementary to each other. In some embodiments, the method provides a first plurality of adaptor connected double-stranded nucleic acid molecules. In some embodiments, the method comprises adding a polymerizing enzyme (e.g., adding a polymerase enzyme to the first plurality of adaptor connected double-stranded nucleic acid molecules). In some embodiments, adding a polymerase enzyme is in the absence of a primer. In some embodiments, the method does not comprise adding a primer. In some embodiments, the polymerizing enzyme forms a first set of adaptor connected double-stranded nucleic acid concatemers. In some embodiments, forming a first set of adaptor connected double-stranded nucleic acid concatemers is by joining two or more adaptor connected double-stranded nucleic acid molecules by the one or more overhang sequences. In some embodiments, the method comprises adding a second plurality of adaptor molecules to the first set (e.g., first adaptor molecules). In some embodiments, the second plurality of adaptor molecules comprise one or more overhang sequences. In some embodiments, at least two of the one or more overhang sequences are complementary to each other. In some embodiments, the method provides a second set of adaptor connected double-stranded nucleic acid molecules. In some embodiments, any one of the previous embodiments can be repeated with a set of adaptor molecules to yield a concatemer comprising a predetermined average length.

In one embodiment, the present disclosure relates to a method for preparing a concatemer of nucleic acid molecules. In some embodiments, the method comprises subjecting at least one nucleic acid molecule and/or a plurality of double-stranded nucleic acid molecules to end-repair. In some embodiments, the method comprises adding at least one or a plurality of adaptor molecules to the at least one nucleic acid molecule and/or the plurality of double-stranded nucleic acid molecules. In some embodiments, adding at least one or a (first) plurality of adaptor molecules to the at least one nucleic acid molecule and/or the plurality of double stranded nucleic acid molecules comprises ligation. In some embodiments, adding at least one or a (first) plurality of adaptor molecules to the at least one nucleic acid molecule and/or the plurality of double stranded nucleic acid molecules comprises a reverse transcriptase (e.g., R2 reverse transcriptase, or a modified reverse transcriptase). In some embodiments, In some embodiments, the at least one or a plurality of adaptor molecules comprise one or more overhang sequences. In some embodiments, at least two overhang sequences are complementary to each other (e.g., thereby providing a (first) plurality of adaptor connected double-stranded nucleic acid molecules). In some embodiments, the at least one or a plurality of adaptor molecules comprise a sequence (e.g., overhang sequence) that attaches/ligates to the 3' end of the nucleic acid molecule and/or a sequence (e.g., overhang sequence) that attaches/ligates to the 5' end of the nucleic acid molecule. In some embodiments, the nucleic acid molecule comprises adaptors on both the 3' and the 5' end. In some embodiments, the adaptor that binds to the 3' end is complementary to the adaptor that binds to the 5' end. In some embodiments, the sequence of the adaptors is unknown. In some embodiments, the sequence of the adaptors is pre-determined. In some embodiments, the adaptor serves as a template and/or as a primer. In some embodiments, the adaptor that binds to the 3' end of one nucleic acid molecule can bind to an adaptor on the 5' end of another nucleic acid molecule. In some embodiments, the method further comprises adding a polymerase enzyme to the adaptor connected to a nucleic acid molecule. In some embodiments, the method further comprises adding a polymerase to the (first) plurality of adaptor connected double-stranded nucleic acid molecules. In some embodiments, the polymerase is added in the absence of a primer. In some embodiments, the polymerase enzyme forms a first set of adaptor connected double-stranded nucleic acid concatemers by joining two or more adaptor connected double-stranded nucleic acid molecules by the one or more overhang sequences. In some embodiments, the polymerase permits that the adaptor connected to the nucleic acid molecule form concatemers. In some embodiments, the method comprises adding a second plurality of adaptor molecules to the first set. In some embodiments, the second plurality of adaptor molecules comprise one or more overhang sequences. In some embodiments, the at least two overhang sequences are complementary to each other. In some embodiments, a second set of adaptor connected double-stranded nucleic acid molecules is formed. In some embodiments, the concatemer length or the number of attached templates can be determined, for example, by tagging the adaptors with modified nucleotides (e.g., by introducing methylated nucleotides or by inserting dUTP). In some embodiments the length of the concatemer can be regulated based on the ratio between modified/unmodified adaptors. In some embodiments the adaptor sequences can serve as a homology priming location (annealed to the homology spot ssDNA fragments serve as template and primer). In some embodiments, the method comprises amplifying the concatemers by PCR or isothermal reaction. In some embodiments, the reaction in the PCR undergoes a selected number of cycles (the more cycles, the longer the concatemer) or time (isothermal amplification). In some embodiments, the reaction is stopped and the (long) dsDNA concatemers are ligated with two unique dsDNA adaptors. In some embodiments, the length of the concatemer can be manipulated. In some embodiments, the length of the concatemer can be determined at least based on the number of PCR cycles, and/or the amount of time (e.g., in an isothermal amplification), and/or based on the modified nucleotide present in the adaptor. In some embodiments, the adaptor comprises a unique molecular identifier sequence (UMI). In some embodiments, the polymerase enzyme joins two or more adaptor connected double-stranded nucleic acid molecules in a PCR or isothermal amplification reaction. In some embodiments, the adaptor comprises at least one modified nucleotide.

In some embodiments, nucleic acid from a biological sample obtained from a subject is amplified. In some cases, the biological sample is obtained directly from the subject. In some embodiments, a biological sample obtained directly from a subject refers to a biological sample that has been further processed after being obtained from the subject. In some embodiments, a biological sample obtained directly from a subject refers to a biological sample that has not been further processed after being obtained from the subject, with the exception of any approach used to collect the biological sample from the subject for further processing. For example, blood is obtained directly from a subject by accessing the subject's circulatory system, removing the blood from the subject (e.g., via a needle), and entering the removed blood into a receptacle. The receptacle may comprise reagents (e.g., anti-coagulants) such that the blood sample is useful for further analysis. In another example, a swab may be used to access epithelial cells on an oropharyngeal surface of the subject. After obtaining the biological sample from the subject, the swab containing the biological sample can be contacted with a fluid (e.g., a buffer) to collect the biological fluid from the swab.

In some embodiments, a biological sample has been purified. In some embodiments, a biological sample has not been purified. In some embodiments, the nucleic acid of a biological sample has not been extracted when the biological sample is provided to a tube. For example, the RNA or DNA in a biological sample may not be extracted from the biological sample when providing the biological sample to a tube. In some embodiments, a target nucleic acid (e.g., a target RNA or target DNA) present in a biological sample may not be concentrated prior to providing the biological sample to a reaction vessel (e.g., a tube). Any suitable biological sample that comprises nucleic acid may be obtained from a subject.

The present disclosure relates to a non-naturally occurring or modified enzyme (e.g., a non-naturally occurring or modified reverse transcriptase, modified reverse transcriptase) or a modified polypeptide having reverse transcriptase activity that has an improved enzyme property compared to a naturally occurring or wild type or unmodified enzyme (e.g., a wild type reverse transcriptase) or unmodified polypeptide having reverse transcriptase activity. In some embodiments, the non-naturally occurring or modified enzyme is an enzyme with reverse transcriptase activity. In some embodiments, the non-naturally occurring or modified enzyme is a modified reverse transcriptase. In some embodiments, the non naturally occurring or modified enzyme is a modified non-retroviral reverse transcriptase. In some embodiments, the non-naturally occurring or modified enzyme is a modified non-LTR retrotransposon. In some embodiments, the non-naturally occurring or modified enzyme is a modified R2 reverse transcriptase. In some embodiments, a non-naturally occurring or modified enzyme or a modified polypeptide having reverse transcriptase activity can amplify a template nucleic acid molecule at a processivity of at least about 80% per base, of at least about 85% per base, of at least about 88% per base, of at least about 89% per base, of at least about 90% per base, of at least about 91% per base, of at least about 92% per base, of at least about 93% per base, of at least about 94% per base, of at least about 95% per base, of at least about 96% per base, of at least about 97% per base, of at least about 98% per base, of at least about 99% per base, of at least about 99.5% per base, or of about 100% per base.

In some embodiments, a non-naturally occurring or modified enzyme or a modified polypeptide having reverse transcriptase activity can amplify or is capable of amplifying a template nucleic acid molecule at a processivity measured at a temperature of between about 12° C. and about 40° C. In some embodiments, the temperature is between about 10° C. and about 35° C., between about 12° C. and about 30° C., between about 25° C. and about 40° C., or between about 12° C. and about 42° C. In some embodiments, the temperature is between about 8° C. to about 50° C., between about 2° C. to about 60° C., between about 8° C. to about 42° C., between about 6° C. to about 32° C., or between about 7° C. to about 35° C.

In some embodiments, a non-naturally occurring or modified enzyme or a modified polypeptide having reverse transcriptase activity can amplify or is capable of amplifying a template nucleic acid molecule at a processivity of at least about 80% per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or about or at most about 42° C.; of at least about 85% per base at a temperature of about or at most about 12° C., at about or at most about 15° C., at about or at most about 20° C., at about or at most about 25° C., at about or at most about 30° C., at about or at most about 35° C., at about or at most about 40° C., at about or at most about 42° C. at about or at most about 45° C., at about or at most about 50° C.; of at least about 89% per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or at about or at most about 42° C.; of at least about 90% per base at a temperature of about or at most about 12° C., at about or at most about 15° C., at about or at most about 20° C., at about or at most about 25° C., at about or at most about 30° C., at about or at most about 35° C., at about or at most about 40° C., at about or at most about 42° C., at about or at most about 45° C., at about or at most about 50° C.; of at least about 91% per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or at about or at most about 42° C.; of at least about 85% per base at a temperature of about or at most about 12° C., at about or at most about 15° C., at about or at most about 20° C., at about or at most about 25° C. at about or at most about 30° C., at about or at most about 35° C., at about or at most about 40° C., at about or at most about 42° C., at about or at most about 45° C., at about or at most about 50° C.; of at least about 95% per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or about or at most about 42° C.; of at least about 85% per base at a temperature of about or at most about 12° C., at about or at most about 15° C., at about or at most about 20° C., at about or at most about 25° C., at about or at most about 30° C., at about or at most about 35° C., at about or at most about 40° C., at about or at most about 42° C., at about or at most about 45° C., at about or at most about 50° C.; of at least about 99%, per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or at about or at most about 42° C.; of at least about 85% per base at a temperature of about or at most about 12° C. at about or at most about 15° C., at about or at most about 20° C., at about or at most about 25° C., at about or at most about 30° C., at about or at most about 35° C., at about or at most about 40° C., at about or at most about 42° C., at about or at most about 45° C., at about or at most about 50° C.; of at least about 99.5% per base at at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or about or at most about 42° C.; of at least about 85% per base at a temperature of about or at most about 12° C., at about or at most about 15° C., at about or at most about 20° C., at about or at most about 25° C., at about or at most about 30° C., at about or at most about 35° C., at about or at most about 40° C., at about or at most about 42° C. at about or at most about 45° C., at about or at most about 50° C.; or of about 100% per base at a temperature at about or at most about 4° C., at about or at most about 8° C., at about or at most about 12° C., at about or at most about 15° C., at about or at most about 20° C., at about or at most about 25° C., at about or at most about 30° C., at about or at most about 35° C., at about or at most about 40° C., or at about or at most about 42° C.; of at least about 85% per base at a temperature of about or at most about 12° C., at about or at most about 15° C., at about or at most about 20° C., at about or at most about 25° C., at about or at most about 30° C., at about or at most about 35° C., at about or at most about 40° C., at about or at most about 42° C., at about or at most about 45° C., at about or at most about 50° C.

In some embodiments, the non-naturally occurring or modified enzyme or a modified polypeptide having reverse transcriptase activity can amplify or is capable of amplifying a template nucleic acid molecule at a processivity of at least about 80% per base at a temperature of at most about 35° C., of at least about 85% per base at a temperature of at most about 40° C., of at least about 88% per base at a temperature of at most about 35° C., of at least about 89% per base at a temperature of at most about 40° C. of at least about 90% per base at a temperature of at most about 35° C., of at least about 91% per base at a temperature of at most about 35° C., of at least about 92% per base at a temperature of at most about 40° C., of at least about 93% per base at a temperature of at most about 35° C., of at least about 94% per base at a temperature of at most about 40° C., of at least about 95% per base at a temperature of at most about 35° C., of at least about 96% per base at a temperature of at most about 40° C., of at least about 97% per base at a temperature of at most about 35° C. of at least about 98% per base at a temperature of at most about 40° C., of at least about 99% per base at a temperature of at most about 40° C., of at least about 99.5% per base at a temperature of at most about 40° C., or of about 100% per base at a temperature of at most about 40° C.

In some embodiments, the improved enzyme property is selected from at least one of the following: improved stability (e.g., improved thermostability), improved specific activity, improved protein expression, improved purification, improved processivity, improved strand displacement, improved template jumping, improved DNA/RNA affinity, and improved fidelity. In some embodiments, a non-naturally occurring enzyme or a modified enzyme or a modified polypeptide having reverse transcriptase activity amplifies a template nucleic acid molecule. In some embodiments, the non-naturally occurring enzyme or the modified enzyme or the modified polypeptide having reverse transcriptase activity that amplifies a template nucleic acid molecule has a performance index greater than about 1, greater than about 2, greater than about 3, greater than about 4, greater than about 5, greater than about 6, greater than about 7, greater than about 8, greater than about 9, greater than about 10, greater than about 15, greater than about 20, greater than about 25, greater than about 30, greater than about 35, greater than about 40, greater than about 45, greater than about 50, greater than about 60, greater than about 70, greater than about 80, greater than about 90, or greater than about 100 for at least one enzyme property. In some embodiments, the enzyme property and/or the performance index is performed at a temperature equal to or lower than or at most about 50° C., equal to or lower than or at most about 42° C., equal to or lower than or at most about 40° C., equal to or lower than or at most about 39° C., equal to or lower than or at most about 38° C., equal to or lower than or at most about 37° C., equal to or lower than or at most about 36° C., equal to or lower than or at most about 35° C., equal to or lower than or at most about 34° C., equal to or lower than or at most about 33° C., equal to or lower than or at most about 32° C., equal to or lower than or at most about 31° C., equal to or lower than or at most about 30° C., equal to or lower than or at most about 29° C., equal to or lower than or at most about 28° C., equal to or lower than or at most about 27° C., equal to or lower than or at most about 26° C., equal to or lower than or at most about 25° C., equal to or lower than or at most about 23° C., equal to or lower than or at most about 20° C., equal to or lower than or at most about 15° C., equal to or lower than or at most about 13° C., equal to or lower than or at most about 12° C., equal to or lower than or at most about 10° C., equal to or lower than or at most about 8° C., equal to or lower than or at most about 4° C. In some embodiments, the non-naturally occurring enzyme or the modified enzyme (e.g., modified reverse transcriptase) or the modified polypeptide having reverse transcriptase activity exhibits a processivity for a given nucleotide substrate that is at least about 5%, at least about 10%, at least about 15%, at least about 20%, at least about 25%, at least about 30%, at least about 35%, at least about 37.5%, at least about 40%, at least about 45%, at least about 50%, at least about 60%, at least about 70%, at least about 75%, at least about 80%, at least about 90%, at least about 95%, at least about 100%, at least about 110%, at least about 125%, at least about 150%, at least about 170%, at least about 190%, at least about 200%, at least about 250%, at least about 500%, at least about 750%, at least about 1000%, at least about 5000%, or at least about 10000% higher than the processivity of a reference enzyme or a reference polypeptide for the same nucleotide substrate. In some embodiments, the non-naturally occurring enzyme is a non-naturally occurring reverse transcriptase enzyme. In some embodiments, the modified enzyme is a modified reverse transcriptase.

The present disclosure relates to processes and/or methods that require considerably less hands-on time, the protocol is much simpler to perform and requires a much shorter duration time than other methods used for RNA sequencing and/or liquid biopsy, for example. In some embodiments, the methods and processes of the present disclosure comprises a protocol that is less than about 2 hours and/or less than about 30 minutes of hands-on time. In some embodiments, the protocol is less than about 20 hours, less than about 15 hours, less than about 12 hours, less than about 11 hours, less than about 10 hours, less than about 9 hours, less than about 8 hours, less than about 7 hours, less than about 6 hours, less than about 5 hours, less than about 4 hours, less than about 3 hours, less than about 2.5 hours, less than about 2 hours, less than about 1.5 hours, less than about 1 hour, or less than about 30 minutes. In some embodiments, the hands-on time is less than about 5 hours, less than about 4 hours, less than about 3 hours, less than about 2.5 hours, less than about 2 hours, less than about 1.5 hours, less than about 1 hour, less than about 50 minutes, less than about 40 minutes, less than about 35 minutes, less than about 30 minutes, less than about 25 minutes, less than about 20 minutes, or less than about 15 minutes.

In some embodiments, the method for preparing a nucleic acid library and/or a complementary cDNA library comprises preparing the library in at most about 1 hour, at most about 2 hours, at most about 3 hours, at most about 4 hours, at most about 5 hours, at most about 7 hours, at most about 10 hours, at most about 15 hours, or at most about 20 hours.

Figure 2:
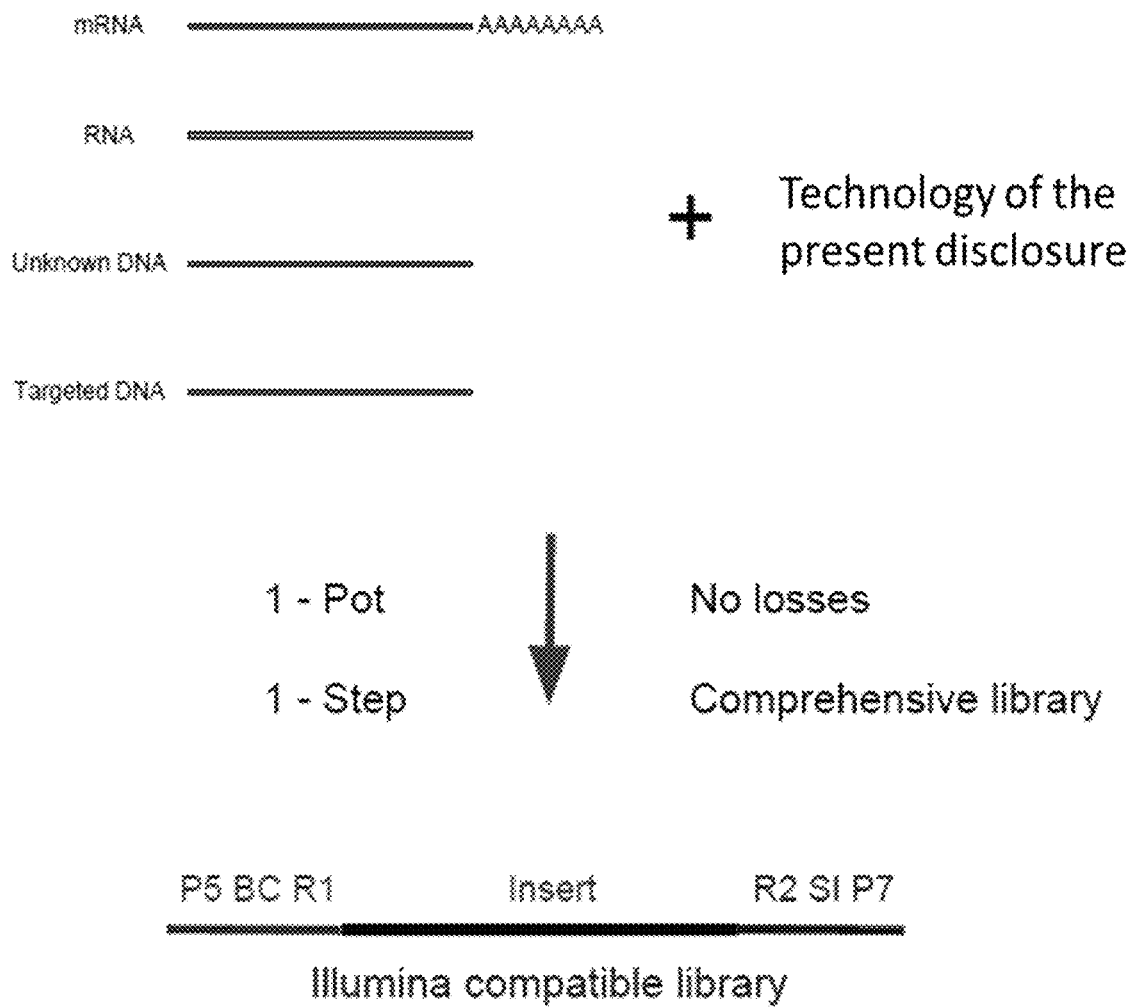
FIG. 2 illustrates a workflow for constructing a library based on the methods of the present disclosure.

In one embodiment, the present disclosure relates to methods and processes that enable the discovery of novel markers and mutations for cancer, and/or provides approaches for precision medicine. In some embodiments, the methods and processes disclosed herein provides for higher sensitivity to capture minor allele in ctDNA of <0.1% (available current methods have sensitivity >1%). In some embodiments, the methods and/or processes of the present disclosure comprise a 1-pot (e.g., single vessel), 1-step protocol, and the library is prepared from a sample in an amount of time that is equal to or less than about 2 hours. See FIG. 2.

The present disclosure relates to methods for preparing a modified reverse transcriptase, which method comprises at least one of the following steps: (a) subjecting a nucleic acid sequence encoding a reverse transcriptase enzyme to random or rational mutagenesis; (b) subjecting a nucleic acid sequence encoding a reverse transcriptase enzyme to truncation of amino acids; (c) subjecting a nucleic acid sequence encoding a reverse transcriptase enzyme to alteration comprising an insertion, a deletion or a substitution of an amino acid residue; and (d) subjecting a nucleic acid sequence encoding a reverse transcriptase enzyme to fusion with a protein or domain. In some embodiments, the nucleic acid sequence obtained in any one of steps (a) to (d) is expressed in a host cell. In some embodiments, the modified reverse transcriptase comprises at least one improved enzyme property relative to a wild type or unmodified reverse transcriptase. In some embodiments the nucleic acid sequence is DNA, RNA, or a combination of RNA and DNA. In some embodiments, the method comprises screening for host cells expressing modified reverse transcriptase(s). In some embodiments, the method comprises preparing modified reverse transcriptase(s) expressed by the host cell(s). In some embodiments, the method may comprise purifying the modified reverse transcriptase(s) according to any method including any method disclosed herein. In some embodiments, the method may comprise determining the reverse transcriptase activity, estimating the reverse transcriptase activity fractions, and/or testing the stability and/or robustness of the modified reverse transcriptase(s). In some embodiments, determining the reverse transcriptase activity, estimating the reverse transcriptase activity fractions, and/or testing the stability and/or robustness of the modified reverse transcriptase(s) are performed or tested using a reverse transcriptase activity assay. In some embodiments, the reverse transcriptase activity, the reverse transcriptase active fraction, and/or the stability and/or robustness of the modified reverse transcriptase(s) is increased/improved compared to the unmodified or naturally occurring reverse transcriptase.

The present disclosure relates to methods for preparing a complementary deoxyribonucleic acid (cDNA) molecule. In some embodiments, the method comprises annealing a primer to a template nucleic acid molecule, thereby generating an annealed template nucleic acid molecule. In some embodiments, the method further comprises mixing, in the presence of nucleotides, the annealed template nucleic acid molecule, a one or more acceptor nucleic acid molecules, and a modified reverse transcriptase. In some embodiments, the modified reverse transcriptase generates a plurality of continuous complementary deoxyribonucleic acid molecules. In some embodiments, the plurality of continuous complementary deoxyribonucleic acid molecules are prepared in at most about 2 hours. In some embodiments, the plurality of continuous complementary deoxyribonucleic acid molecules is generated by having the modified reverse transcriptase reverse transcribe a sequence of the annealed template nucleic acid molecule. In some embodiments, the modified reverse transcriptase then migrates to an acceptor nucleic acid molecule (e.g., one or more acceptor nucleic acid molecules). In some embodiments, the reverse transcriptase (e.g., modified reverse transcriptase) is able to reverse transcribe a sequence of the template and/or the acceptor nucleic acid molecule at a temperature of from about 12° C. to about 42° C. In some embodiments, the reverse transcriptase (e.g., modified reverse transcriptase) is able to reverse transcribe a sequence of the template and/or the acceptor nucleic acid molecule at a temperature of from about 8° C. to about 50° C. (e.g., about 8° C., about 15° C. about 20° C., about 25° C., about 30° C., about 35° C., about 40° C., about 45° C. about 48° C.). In some embodiments, the reverse transcriptase (e.g., modified reverse transcriptase) is able to reverse transcribe a sequence of the template and/or the acceptor nucleic acid molecule at a temperature of at most about 4° C., at most about 8° C., at most about 15° C., at most about 20° C., at most about 25° C., at most about 30° C., at most about 35° C., at most about 40° C., at most about 45° C., or at most about 48° C. In some embodiments, reverse transcription occurs at an error rate of at most about 5%. In some embodiments, the reverse transcriptase (e.g., modified reverse transcriptase) is capable of reverse transcribing the template and/or the acceptor nucleic acid molecule at an error rate of at most about 45%, at most about 40%, at most about 35%, at most about 30%, at most about 25%, at most about 20%, at most about 15%, at most about 10%, at most about 8%, at most about 7%, at most about 6%, at most about 5%, at most about 4%, at most about 3%, at most about 2%, or at most about 1%. In some embodiments, the reverse transcriptase (e.g., modified reverse transcriptase) can migrate from the template to the acceptor nucleic acid molecule independently of sequence identity between the template and the acceptor nucleic acid molecule. In some embodiments, the method is prepared in a single vessel. In some embodiments, the template nucleic acid molecule is a fragmented DNA template, a fragmented RNA template, a non-fragmented DNA template, a non-fragmented RNA template, or a combination thereof. In some embodiments, the method further comprises adding a tag to a template nucleic acid molecule, thereby generating a plurality of tagged continuous complementary deoxyribonucleic acid molecules. In some embodiments, the method further comprises performing a polymerase chain reaction amplification reaction, thereby forming one or more amplicons.

Figure 3:
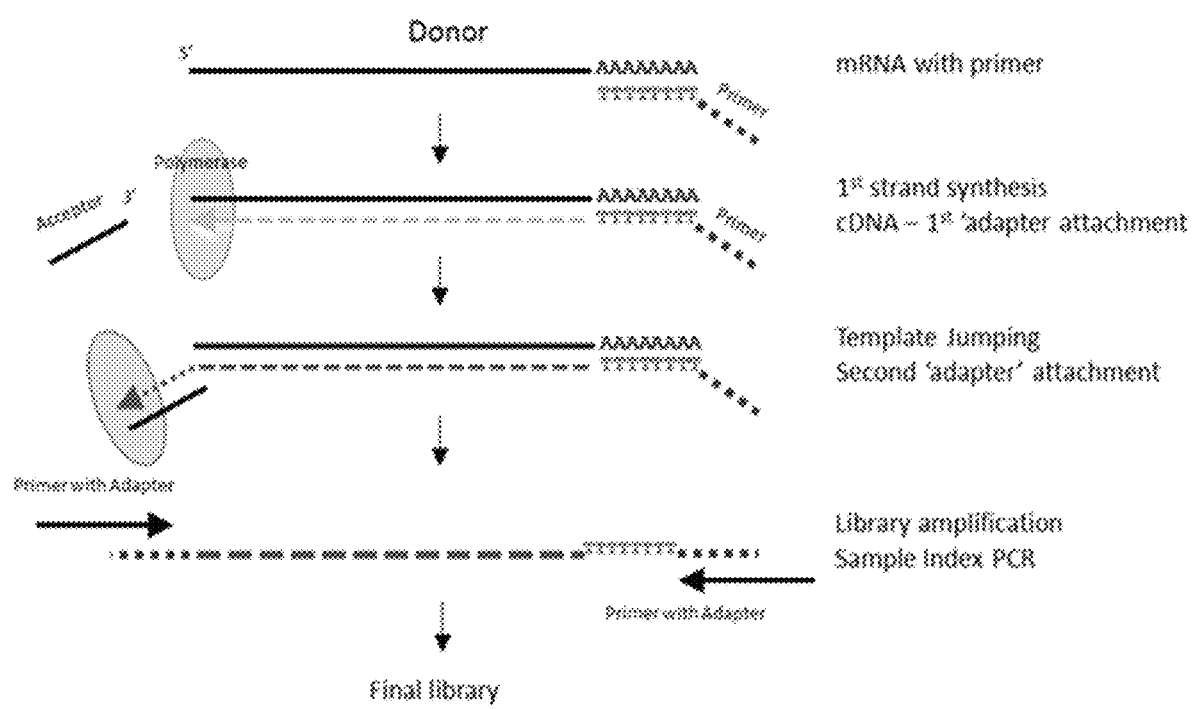
FIG. 3 illustrates a workflow for constructing a library.

The present disclosure relates to methods for preparing a complementary deoxyribonucleic acid (cDNA) molecule using a modified reverse transcriptase. In some embodiments, the method for preparing a cDNA molecule is via template jumping. In some embodiments, the modified reverse transcriptase has an improved enzyme property compared to a naturally occurring or unmodified or wild type enzyme (e.g., wild type reverse transcriptase). In some embodiments, the method for preparing a cDNA molecule comprises: (a) annealing a primer to a template; and (b) mixing, in the presence of nucleotides (e.g., dNTPs), the template annealed to the primer with a modified reverse transcriptase and an acceptor nucleic acid molecule (e.g., acceptor RNA, DNA, or a combination thereof) under conditions sufficient to generate a cDNA molecule complementary to the template and/or to the acceptor nucleic acid molecule (FIG. 3). In some embodiments, the enzyme (e.g., modified reverse transcriptase) generates a continuous cDNA molecule by migrating from the template to the acceptor nucleic acid molecule. In some embodiments, template jumping is independent of sequence identity between the template and the acceptor nucleic acid molecule. In some embodiments, step (a) and step (b) are done at the same time. In some embodiments, step (a) comprises step (b) (e.g., step (a) and step (b) are merged into one step). In some embodiments, at least one of step (a) and/or step (b) further comprises addition of a hot start thermostable polymerase. In some embodiments, the method of the present disclosure is performed in a single tube. In some embodiments, the method of the present disclosure further comprises a polymerase chain reaction (PCR) amplification reaction. In some embodiments, the PCR amplification reaction is performed in a single tube (e.g., the same one tube from steps (a) and (b)). In some embodiments, all the steps of the method of the present disclosure are performed in a single tube.

The present disclosure relates to a method for preparing a concatemer of nucleic acid molecules for sequencing. In some embodiments, the method comprises ligating a nucleic acid molecule with a first adaptor. In some embodiments, the method further comprises amplifying the ligated nucleic acid molecule by performing a nucleic acid amplification reaction to form a concatemer. In some embodiments, the amplification reaction is performed in the absence of a primer. In some embodiments, the method further comprises ligating the concatemer with a second adaptor. In some embodiments, the adaptor(s) (first and/or second adaptor) is/are designed to allow recombination or homology based annealing and extension of molecules (e.g., nucleic acid molecules, and/or a template, and/or a primer, and/or an acceptor). In some embodiments, the nucleic acid amplification reaction is polymerase chain reaction (PCR) or isothermal amplification. In some embodiments, the first adaptor comprises a unique molecular identifier (UMI) sequence. In some embodiments, the first adaptor serves as a primer. In some embodiments, the first adaptor comprises single stranded nucleic acid. In some embodiments, the single stranded nucleic acid comprises single stranded DNA (ssDNA). In some embodiments, the second adaptor comprises double stranded nucleic acid. In some embodiments, the double stranded nucleic acid comprises double stranded DNA (dsDNA). In some embodiments, the first adaptor is different from the second adaptor. In some embodiments, the first adaptor comprises two or more adaptors. In some embodiments, the second adaptor comprises two or more adaptors. In some embodiments, both ends of the nucleic acid molecule comprise an adaptor. In some embodiments, only one end of the nucleic acid molecule comprises an adaptor. In some embodiments, both the 3' and the 5' ends of a nucleic acid molecule comprise an adaptor.

The present disclosure relates to methods for preparing a complementary deoxyribonucleic acid (cDNA) molecule using a modified reverse transcriptase. In some embodiments, the method for preparing a cDNA molecule is via template jumping. In some embodiments, the modified reverse transcriptase has an improved enzyme property compared to a naturally occurring or unmodified or wild type enzyme (e.g., wild type reverse transcriptase). In some embodiments, the method for preparing a cDNA molecule comprises mixing, in the presence of nucleotides (e.g., dNTPs), a primer, a template, a modified reverse transcriptase and an acceptor nucleic acid molecule (e.g., acceptor RNA, DNA, or a combination thereof) under conditions sufficient to generate a cDNA molecule complementary to the template and/or to the acceptor nucleic acid molecule. In some embodiments, the method comprises addition of a hot start thermostable polymerase (e.g., to the mixing step). In some embodiments, the method of the present disclosure is performed in a single tube. In some embodiments, the method of the present disclosure further comprises a polymerase chain reaction (PCR) amplification reaction. In some embodiments, the PCR amplification reaction is performed in a single tube (e.g., the same one tube as the mixing step). In some embodiments, all the steps of the method of the present disclosure is performed in a single tube (single vessel).

Figure 4:
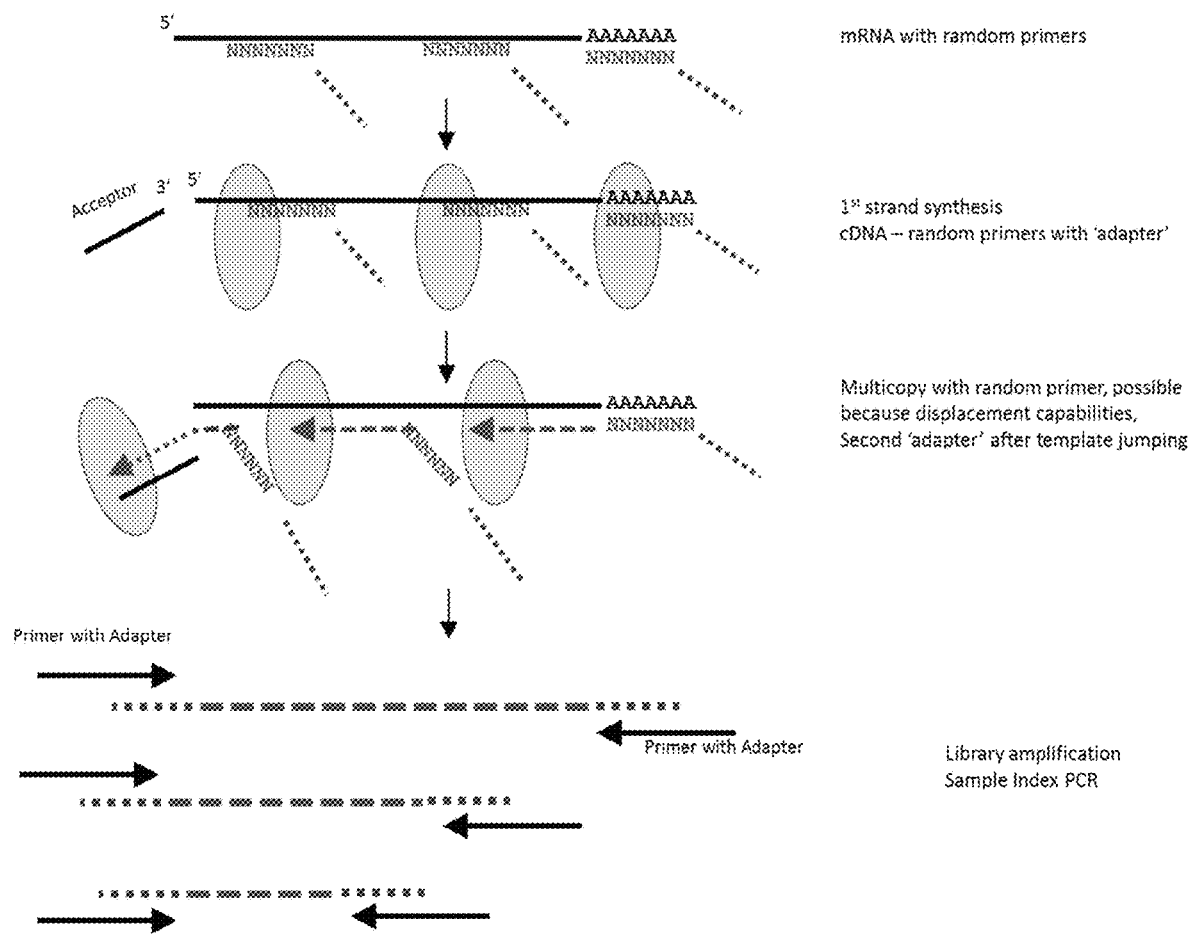
FIG. 4 illustrates a workflow using random primers for constructing a library.

In some embodiments, the method for preparing a cDNA molecule comprises: (a) annealing one or more primer(s) to a template; and (b) mixing, in the presence of nucleotides (e.g., dNTPs), the template annealed to one or more primer(s) with a modified reverse transcriptase and an acceptor nucleic acid molecule (e.g., acceptor RNA, DNA, or a combination thereof) under conditions sufficient to generate a cDNA molecule complementary to the template and/or to the acceptor nucleic acid molecule (FIG. 4). In some embodiments, the method for preparing a cDNA molecule is via template jumping. In some embodiments, step (a) and step (b) are done at the same time. In some embodiments, step (a) comprises step (b) (e.g., step (a) and step (b) are merged into one step). In some embodiments, at least one of step (a) and/or step (b) further comprises addition of a hot start thermostable polymerase. In some embodiments, the method of the present disclosure is performed in a single tube. In some embodiments, the method of the present disclosure further comprises a polymerase chain reaction (PCR) amplification reaction. In some embodiments, the PCR amplification reaction is performed in a single tube (e.g., the same one tube used in or from steps (a) and (b)). In some embodiments, all the steps of the method of the present disclosure is performed in a single tube.

In some embodiments, the method for preparing a cDNA molecule comprises mixing, in the presence of nucleotides (e.g., dNTPs), one or more primer(s), a template, a modified reverse transcriptase, and an acceptor nucleic acid molecule (e.g., acceptor RNA, DNA, or a combination thereof) under conditions sufficient to generate a cDNA molecule complementary to the template and/or to the acceptor nucleic acid molecule. In some embodiments, the method for preparing a cDNA molecule is via template jumping. In some embodiments, the method comprises addition of a hot start thermostable polymerase (e.g., to the mixing step). In some embodiments, the method of the present disclosure is performed in a single tube. In some embodiments, the method of the present disclosure further comprises a polymerase chain reaction (PCR) amplification reaction. In some embodiments, the PCR amplification reaction is performed in a single tube (e.g., the same one tube as the mixing step). In some embodiments, all the steps of the method of the present disclosure is performed in a single tube.

Figure 5A:
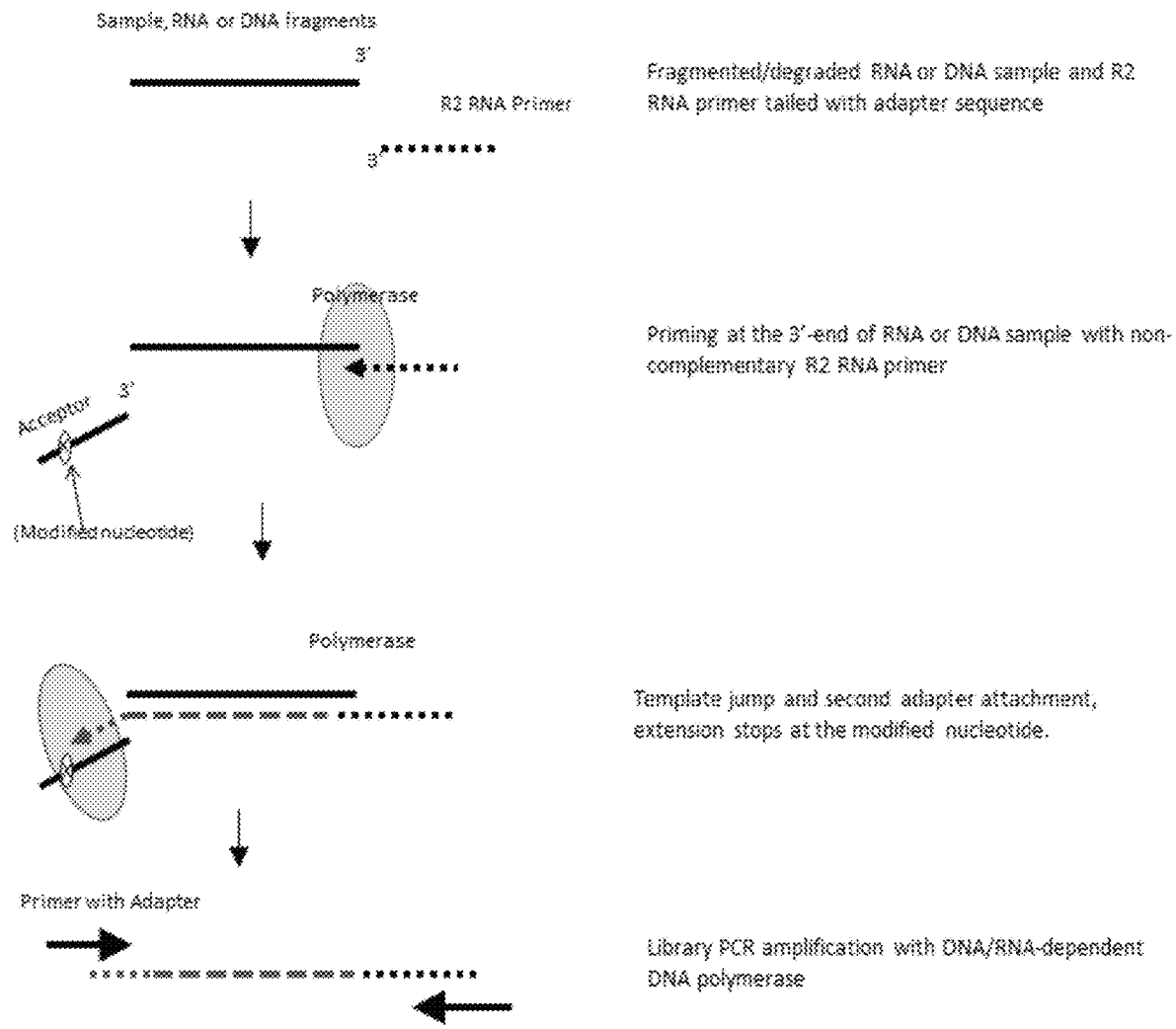
FIG. 5A illustrates a workflow using fragmented or degraded ribonucleic acid (RNA) or deoxyribonucleic acid (DNA) with RNA priming for constructing a library.
Figure 5B:
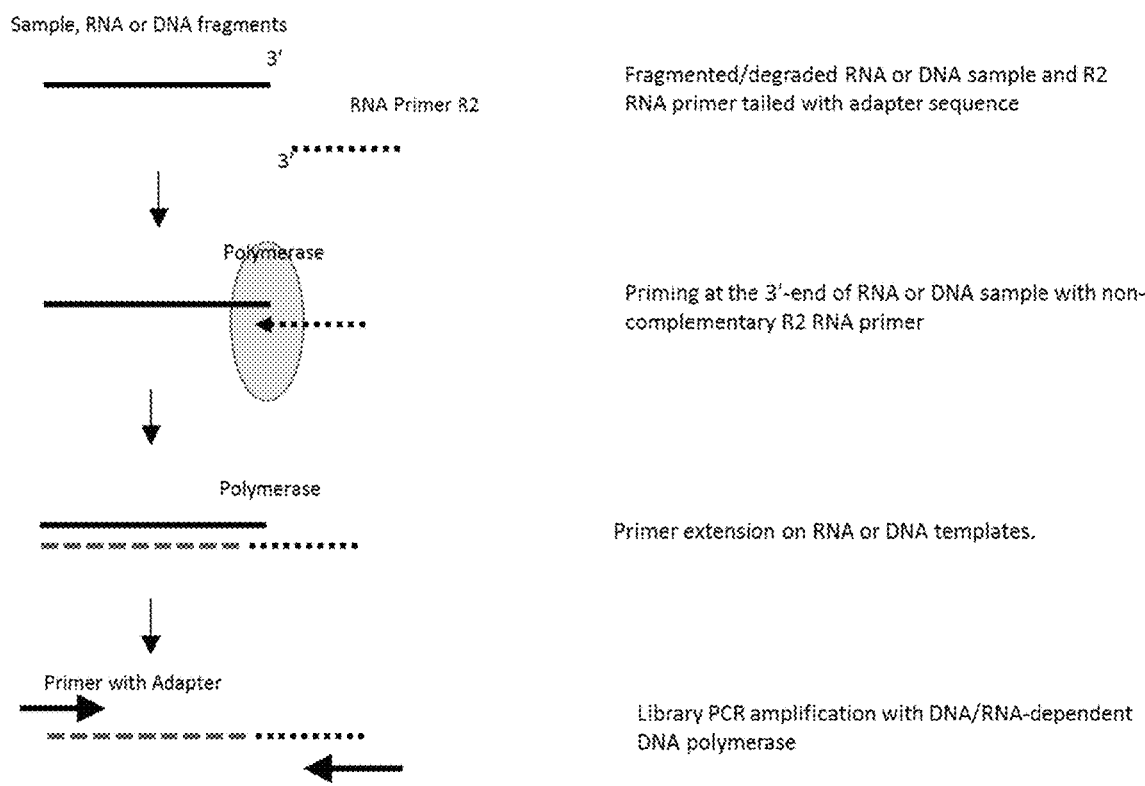
FIG. 5B illustrates an example of a workflow using fragmented or degraded RNA or DNA with RNA priming for constructing a library—method with specific primer.

The present disclosure relates to methods for preparing a nucleic acid molecule comprising: mixing, in the presence of nucleotides (e.g., dNTPs), a fragment or degraded template (e.g., a nucleic acid fragment), a primer, a modified reverse transcriptase, and an acceptor nucleic acid molecule under conditions sufficient to generate a nucleic acid molecule (FIGS. 5A and 5B). In some embodiments, the acceptor nucleic acid molecule comprises a modified nucleotide. In some embodiments, the primer extension stops at the modified nucleotide. In some embodiments, the modified reverse transcriptase comprises at least one improved enzyme property relative to a wild type, naturally occurring, or unmodified reverse transcriptase. In some embodiments, the primer is an RNA primer. In some embodiments, the primer is an engineered primer (e.g., engineered RNA primer). In some embodiments, the primer has been optimized. In some embodiments, the primer is an optimized and/or engineered primer (e.g., optimized and/or engineered RNA primer). In some embodiments, the primer is RNA R2 primer. In some embodiments, the method for preparing a nucleic acid molecule is via template jumping. In some embodiments, the mixing step of the method of the present disclosure further comprises addition of a hot start thermostable polymerase. In some embodiments, the method of the present disclosure is performed in a single tube. In some embodiments, the method of the present disclosure further comprises a polymerase chain reaction (PCR) amplification reaction. In some embodiments, the PCR amplification reaction is performed in the same single tube. In some embodiments, all the steps of the method of the present disclosure is performed in a single tube.

Figure 6A:
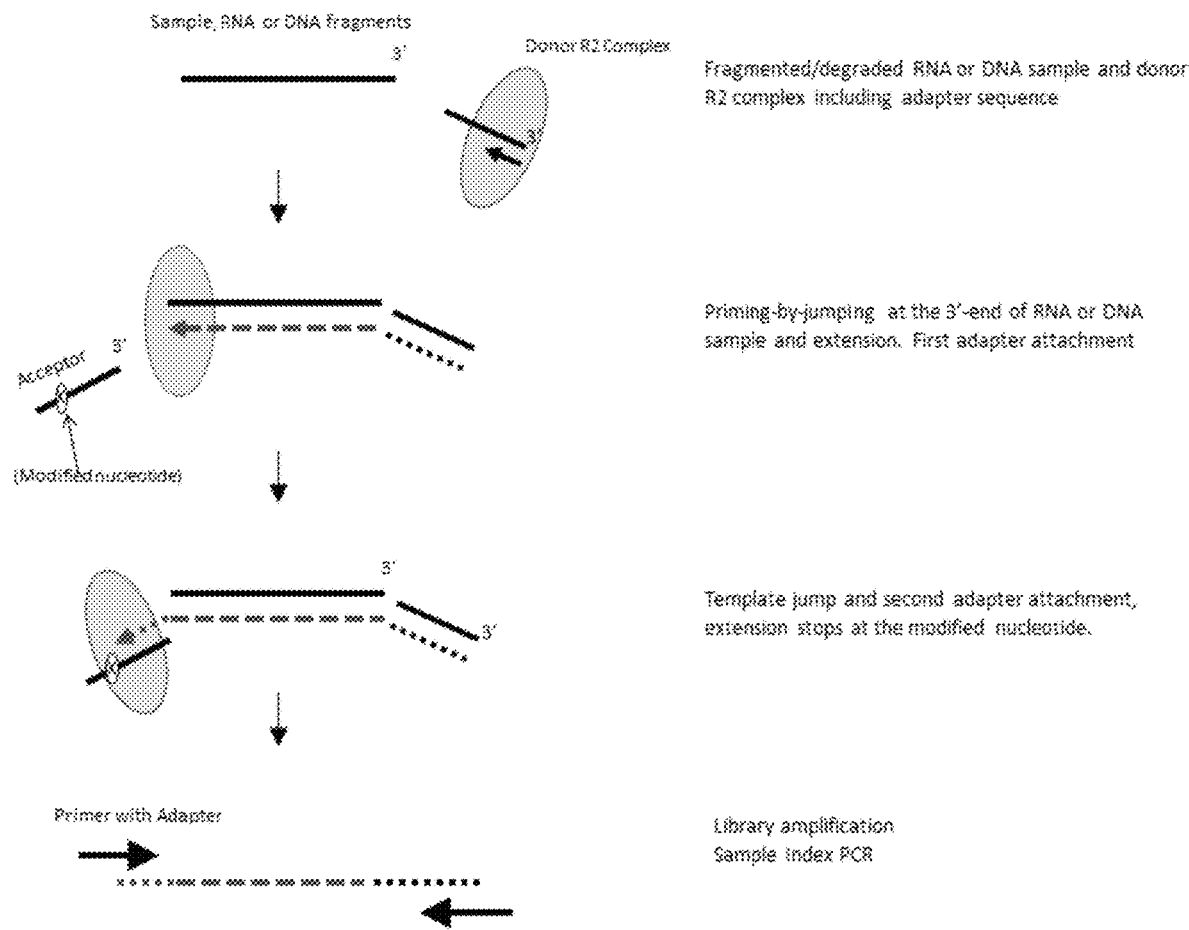
FIG. 6A illustrates a workflow using fragmented or degraded RNA or DNA with a donor complex for constructing a library.
Figure 6B:
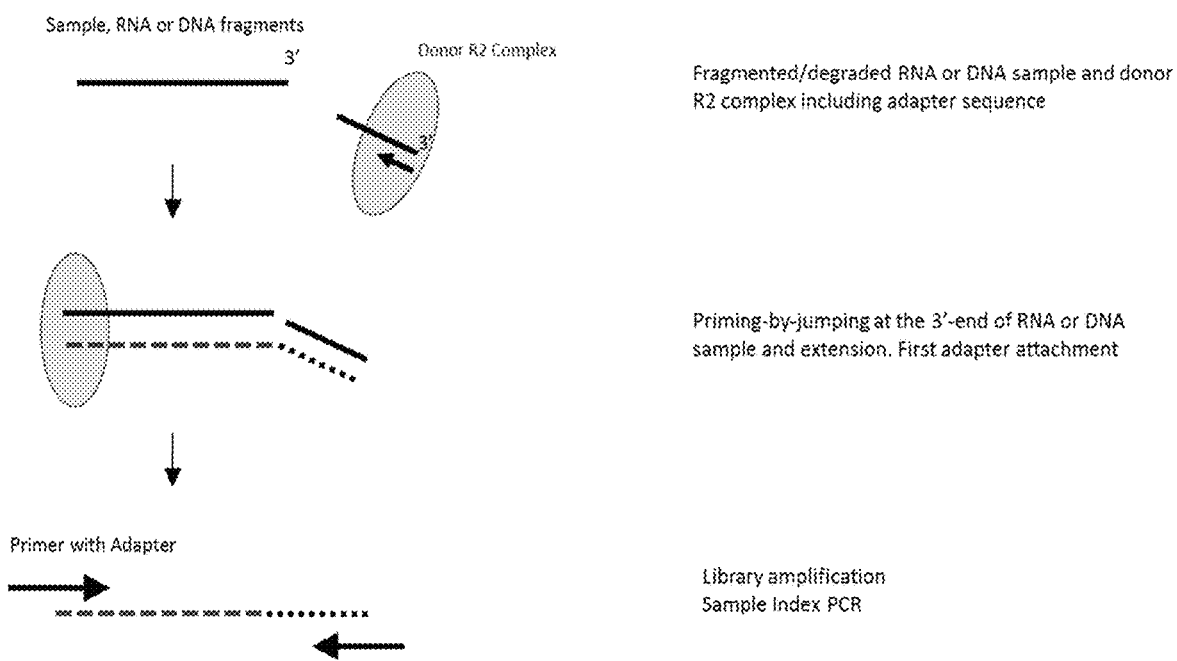
FIG. 6B illustrates an example of a workflow using fragmented or degraded RNA or DNA with a donor complex for constructing a library—with specific primer.
Figure 7:
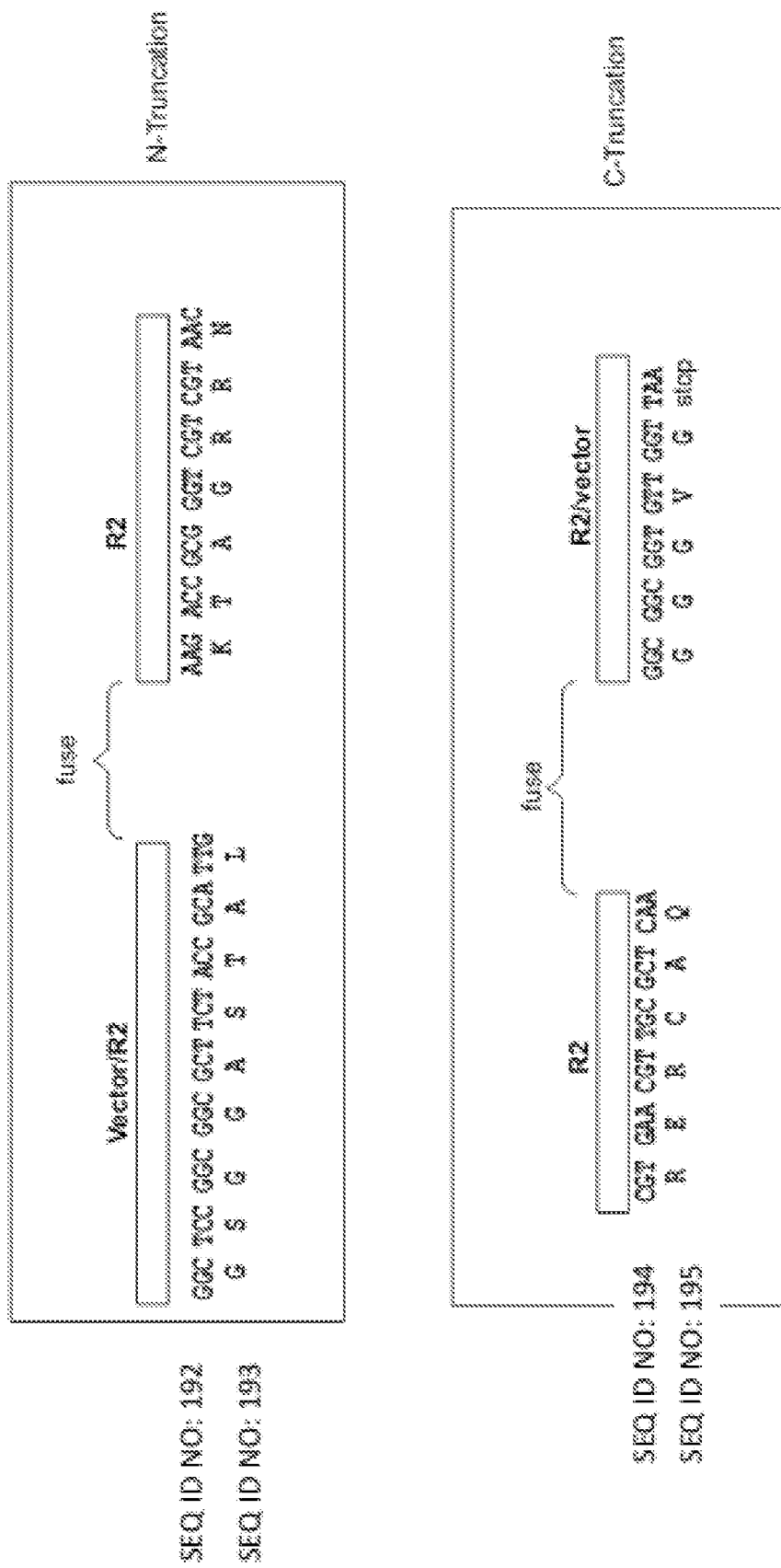
FIG. 7 illustrates a schematic representation of an N-terminal and a C-terminal deletion of an R2 reverse transcriptase.
Figure 8:
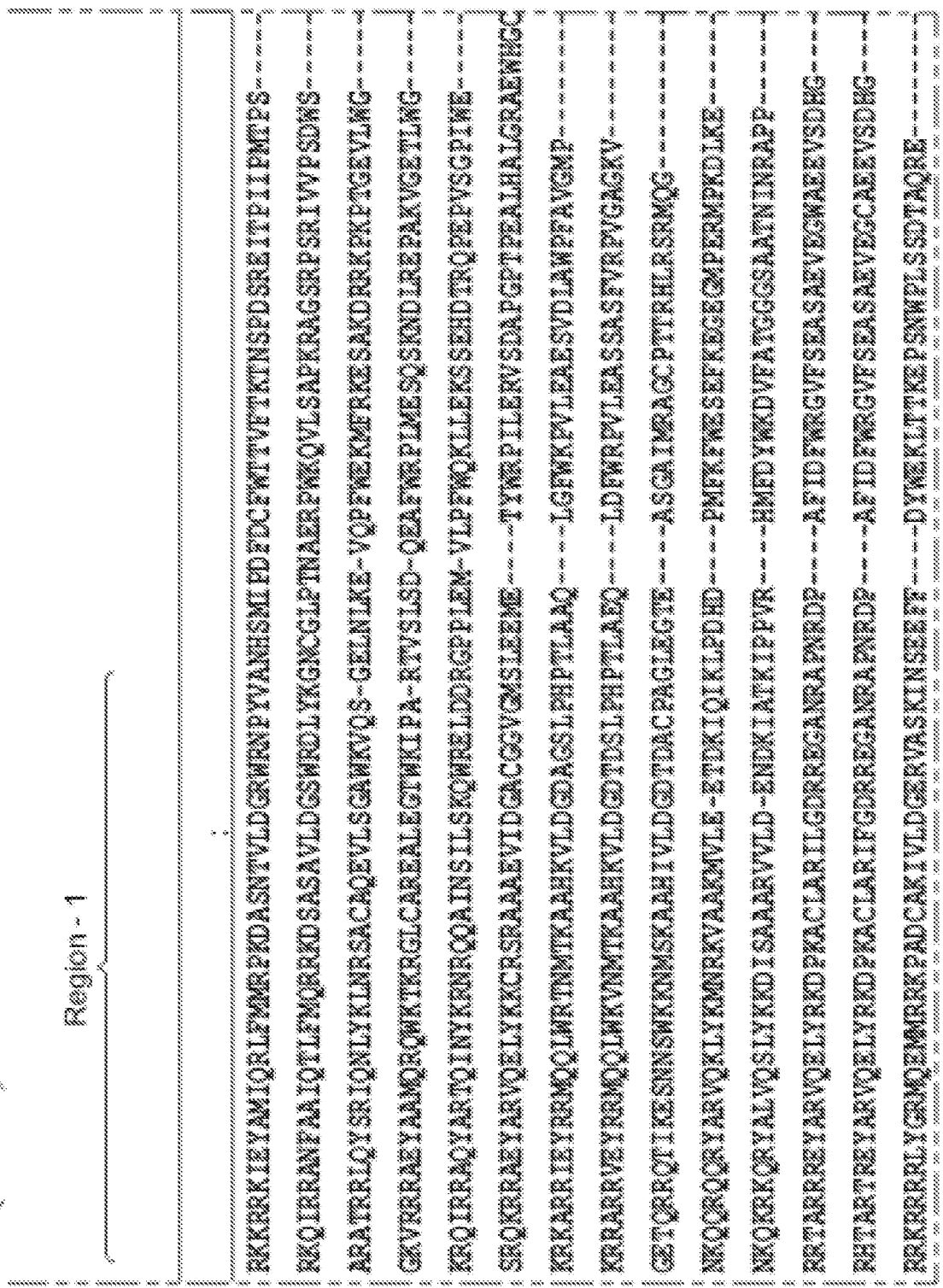
FIG. 8 illustrates a sequence analysis with selected non-long terminal repeat (LTR) retrotransposon and an example of a site of N-deletion upstream two conservative regions (region −1 and region 0)
Figure 8:
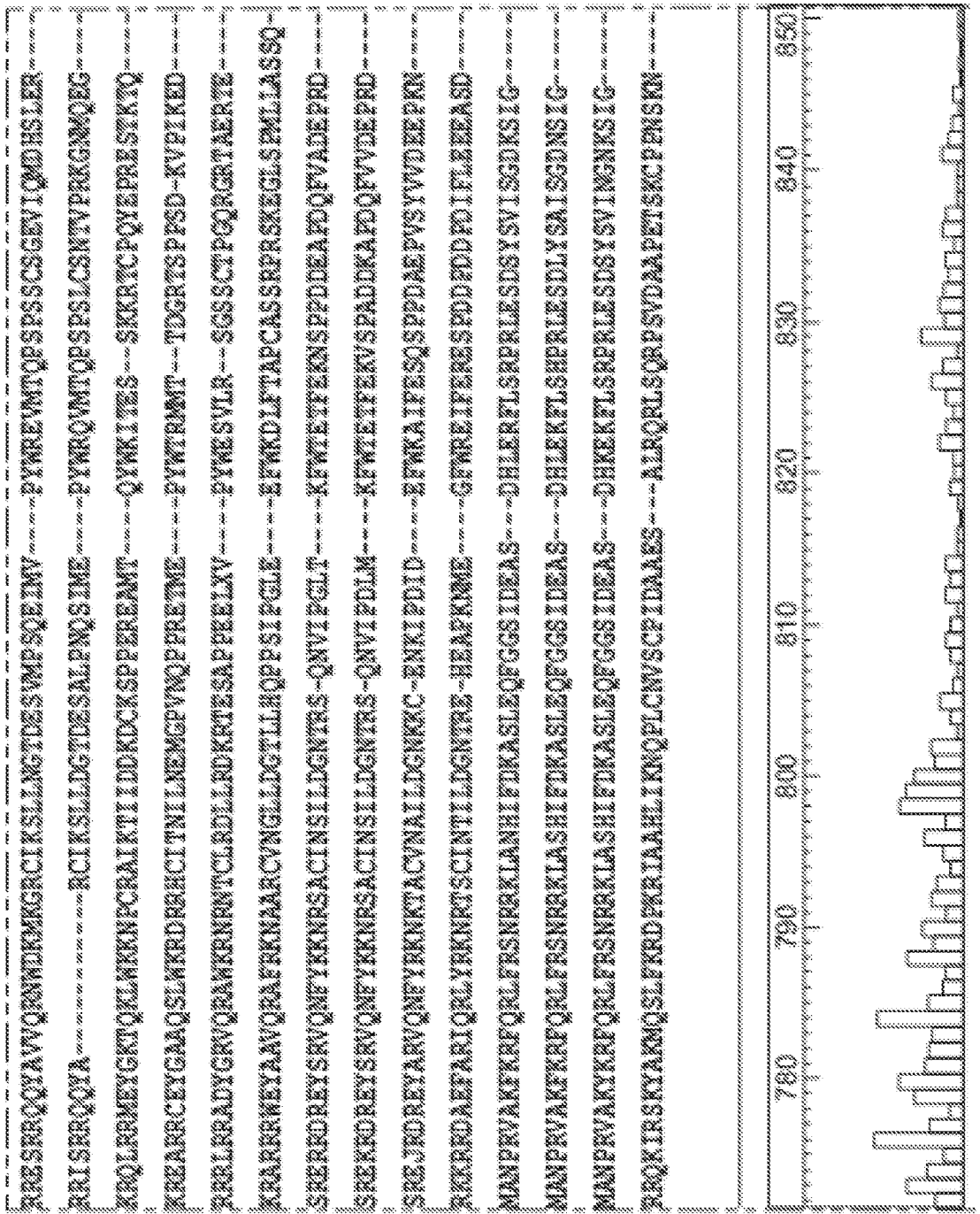
Figure 8:
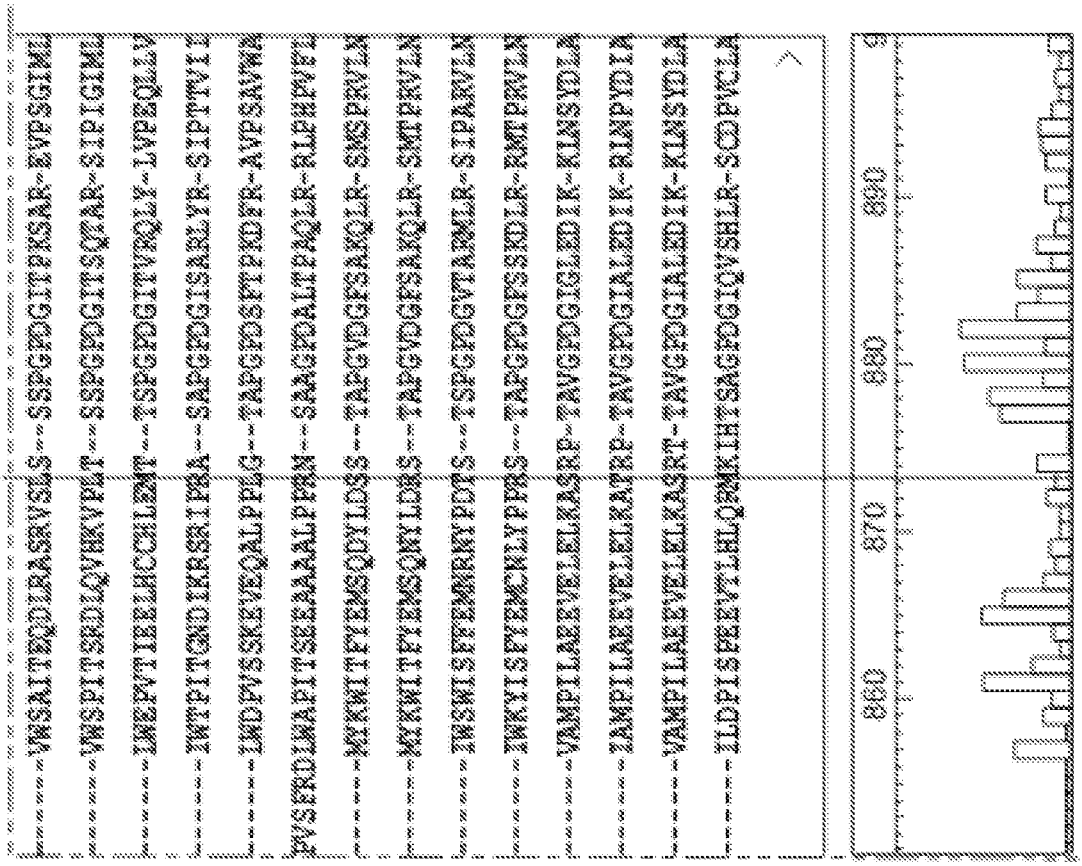
Figure 9:
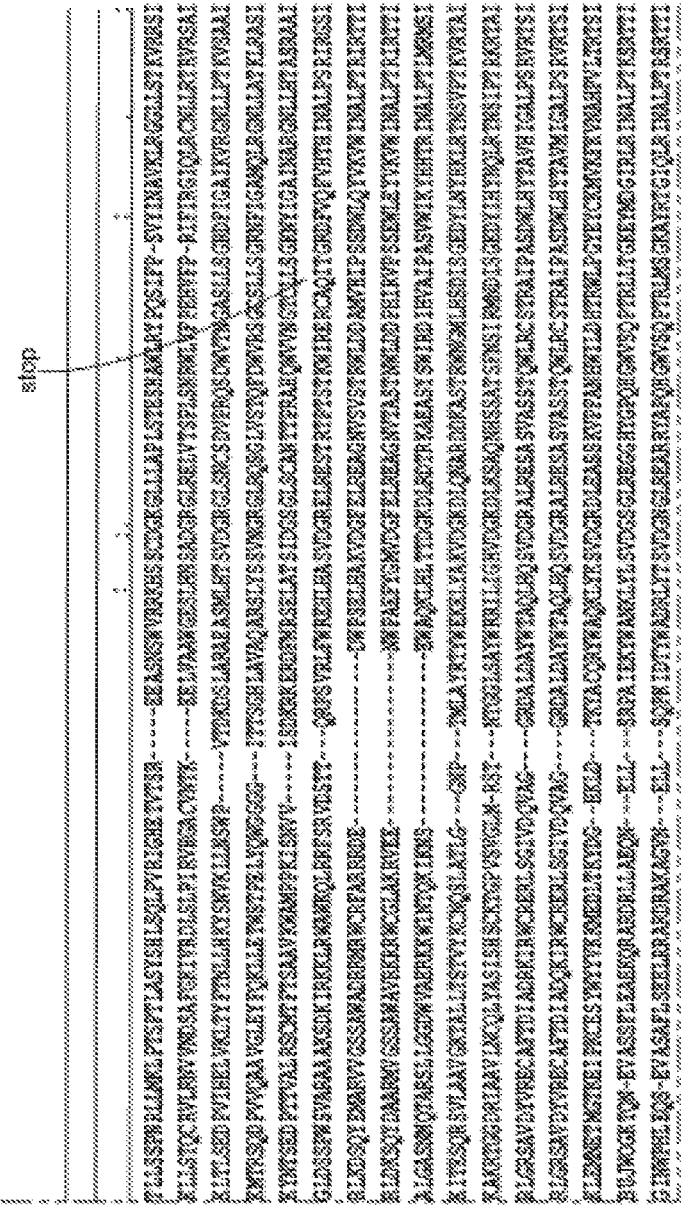
FIG. 9 illustrates a sequence analysis with selected non-LTR retrotransposon and an example of a site of C-terminal deletion downstream two conservative motifs 8* and 9*.
Figure 9:
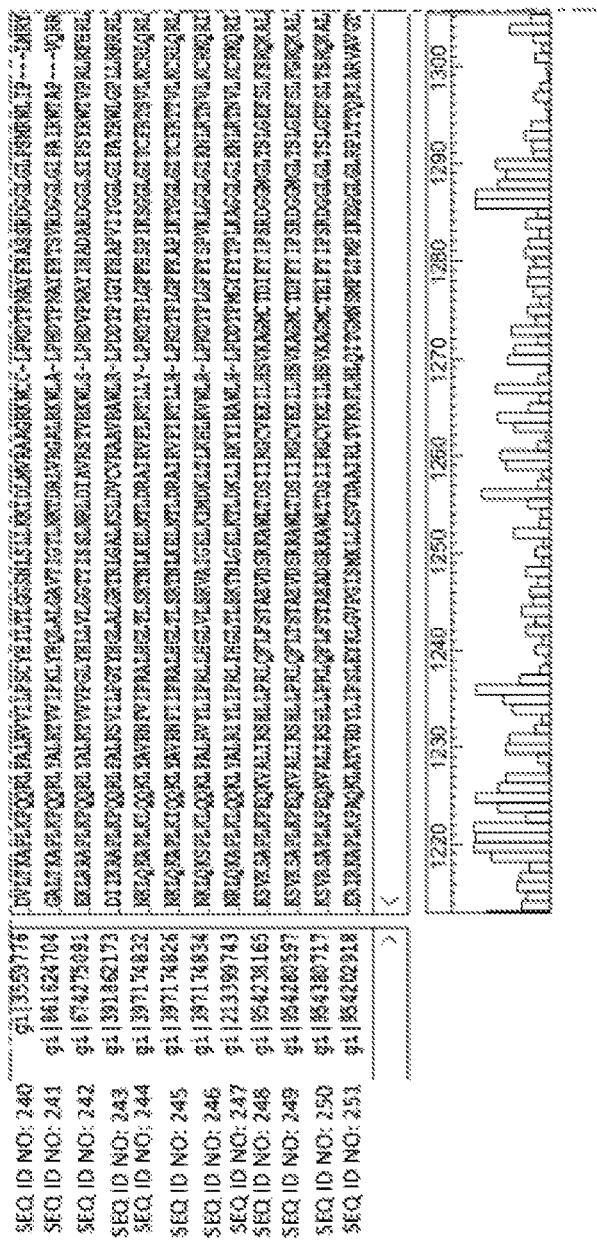
Figure 9:
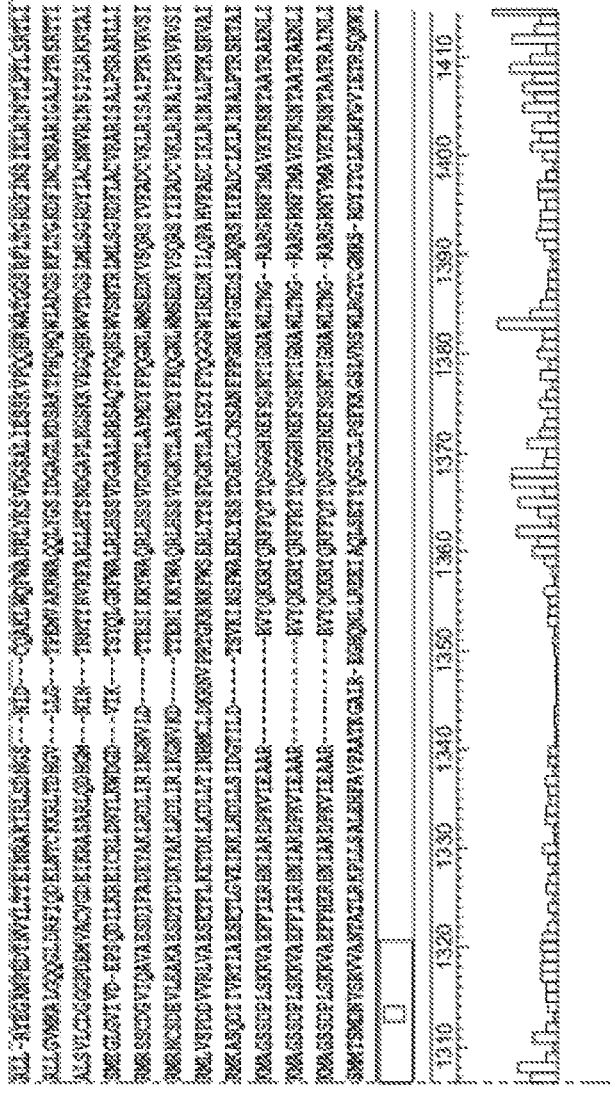

The present disclosure relates to methods for preparing a nucleic acid molecule comprising: mixing, in the presence of nucleotides (e.g., dNTPs), a fragment or degraded template (e.g., a nucleic acid fragment), a donor complex, a modified reverse transcriptase, and an acceptor nucleic acid molecule under conditions sufficient to generate a nucleic acid molecule (FIGS. 6A and 6B). In some embodiments, the acceptor nucleic acid molecule comprises a modified nucleotide. In some embodiments, the primer extension stops at the modified nucleotide. In some embodiments, the modified reverse transcriptase comprises at least one improved enzyme property relative to a wild type or naturally occurring or unmodified reverse transcriptase. In some embodiments, the donor complex comprises a template and a primer. In some embodiments, the donor complex is a donor R2 complex. In some embodiments, the donor R2 complex comprises an RNA R2 primer. In some embodiments, the method for preparing a nucleic acid molecule is via template jumping. In some embodiments, the mixing step of the method of the present disclosure further comprises addition of a hot start thermostable polymerase. In some embodiments, the method of the present disclosure is performed in a single tube. In some embodiments, the method of the present disclosure further comprises a polymerase chain reaction (PCR) amplification reaction. In some embodiments, the PCR amplification reaction is performed in the same single tube (e.g., the same single tube used to prepare a nucleic acid molecule). In some embodiments, all the steps of the method of the present disclosure is performed in a single tube.

The present disclosure relates to methods for preparing a complementary deoxyribonucleic acid (cDNA) library using a modified reverse transcriptase. In some embodiments, the method for preparing a cDNA library uses template jumping. In some embodiments, the modified reverse transcriptase has an improved enzyme property compared to a naturally occurring or wild type or unmodified enzyme (e.g., wild type reverse transcriptase). In some embodiments, the method for preparing a cDNA library comprises: (a) annealing a primer or one or more primer(s) to a template; and (b) mixing, in the presence of nucleotides (e.g., dNTPs), the template annealed to the primer or the template annealed to one or more primer(s) with a modified reverse transcriptase and an acceptor nucleic acid molecule (e.g., acceptor RNA, DNA, or a combination thereof) under conditions sufficient to generate a cDNA molecule complementary to the template and/or to the acceptor nucleic acid molecule. In some embodiments, the method for preparing a cDNA library comprises mixing, in the presence of nucleotides (e.g., dNTPs), a primer or one or more primer(s), a template, a modified reverse transcriptase, and an acceptor nucleic acid molecule (e.g., acceptor RNA, DNA, or a combination thereof) under conditions sufficient to generate a cDNA molecule complementary to the template and/or to the acceptor nucleic acid molecule. In some embodiments, the enzyme (e.g., modified reverse transcriptase) generates a continuous cDNA molecule by migrating from the template to the acceptor nucleic acid molecule. In some embodiments, template jumping is independent of sequence identity between the template and the acceptor nucleic acid molecule. In some embodiments the method further comprises amplifying the cDNA molecule to generate a cDNA library. In some embodiments, step (a) and step (b) are done at the same time. In some embodiments, step (a) comprises step (b) (e.g., step (a) and step (b) are merged into one step). In some embodiments, the mixing step or at least one of step (a) and/or step (b) further comprises addition of a hot start thermostable polymerase. In some embodiments, the method of the present disclosure is performed in a single tube. In some embodiments, the method of the present disclosure further comprises a polymerase chain reaction (PCR) amplification reaction. In some embodiments, the PCR amplification reaction is performed in a single tube (e.g., the same one tube used in or from the mixing step, or in or from steps (a) and (b)). In some embodiments, all the steps of the method of the present disclosure is performed in a single tube.

The present disclosure relates to methods for preparing a cDNA and/or DNA library comprising: mixing, in the presence of nucleotides (e.g., dNTPs), a fragment or degraded template (e.g., a nucleic acid fragment), a primer, a modified reverse transcriptase, and an acceptor nucleic acid molecule under conditions sufficient to generate a nucleic acid (e.g., cDNA and/or DNA) molecule. In some embodiments, the acceptor nucleic acid molecule comprises a modified nucleotide. In some embodiments, the primer extension stops at the modified nucleotide. In some embodiments, the modified reverse transcriptase comprises at least one improved enzyme property relative to a wild type or unmodified reverse transcriptase. In some embodiments, the primer is an RNA R2 primer. In some embodiments, the method further comprises amplifying the nucleic acid (e.g., cDNA and/or DNA) molecule to generate a cDNA library. In some embodiments, the method for preparing a cDNA and/or DNA and/or nucleic acid molecule is via template jumping.

The present disclosure relates to methods for preparing a cDNA and/or DNA library comprising: mixing, in the presence of nucleotides (e.g., dNTPs), a fragment or degraded template (e.g., a nucleic acid fragment), a donor complex, a modified reverse transcriptase, and an acceptor nucleic acid molecule under conditions sufficient to generate a nucleic acid (e.g., cDNA and/or DNA) molecule. In some embodiments, the acceptor nucleic acid molecule comprises a modified nucleotide. In some embodiments, the primer extension stops at the modified nucleotide. In some embodiments, the modified reverse transcriptase comprises at least one improved enzyme property relative to a wild type or unmodified reverse transcriptase. In some embodiments, the donor complex comprises a template and a primer. In some embodiments, the donor complex is a donor R2 complex. In some embodiments, the donor R2 complex comprises an RNA R2 primer. In some embodiments, the method further comprises amplifying the nucleic acid (e.g., cDNA and/or DNA) molecule to generate a cDNA and/or DNA library. In some embodiments, the method for preparing a cDNA and/or DNA and/or nucleic acid molecule molecule is via template jumping.

In some embodiments, the method of the present disclosure may comprise a donor complex. In some embodiments, the donor complex comprises a template and a primer. In some embodiments, the method of the present disclosure may comprise a template. In some embodiments, the template is a fragmented and/or degraded template. In some embodiments, the template is not fragmented. In some embodiments, the template is RNA, DNA, or a combination of DNA and RNA. In some embodiments, the RNA is mRNA. In some embodiments, the template is mRNA.

The present disclosure relates to methods for preparing a library for sequencing comprising: (a) obtaining a sample with cell-free nucleic acid from a subject; and (b) adding a modified reverse transcriptase enzyme, a template (e.g., a nucleic acid template), nucleotides, an acceptor nucleic acid molecule, and one or more primer(s) to the nucleic acid. In some embodiments, the method further comprises conducting an amplification reaction on the cell-free nucleic acid (cf nucleic acid) derived from the sample to produce a plurality of amplicons. In some embodiments, the amplification reaction comprises 35 or fewer amplification cycles. In some embodiments, the method comprises producing a library for sequencing. In some embodiments, the library comprises a plurality of amplicons. In some embodiments, the modified reverse transcriptase is capable of template jumping and/or comprises at least one improved enzyme property relative to a wild type or unmodified reverse transcriptase. In some embodiments, the nucleic acid is DNA, RNA, or a combination of RNA and DNA.

The present disclosure relates to a method for preparing a complementary deoxyribonucleic acid (cDNA) molecule using template jumping, comprising mixing, in a single tube, a primer or one or more primer(s), a messenger RNA (mRNA) template, nucleotides, a modified reverse transcriptase, an acceptor nucleic acid molecule, and a catalytic metal under conditions sufficient to generate a continuous cDNA molecule. In some embodiments, the continuous cDNA molecule is complementary to the mRNA template and/or to the acceptor nucleic acid molecule. In some embodiments, the modified reverse transcriptase comprises at least one improved enzyme property relative to a wild type or unmodified reverse transcriptase. In some embodiments, a continuous cDNA molecule is produced. In some embodiments, the modified reverse transcriptase undergoes migration from the template to the acceptor nucleic acid molecule.

The present disclosure relates to a method for preparing a library for sequencing comprising mixing, in a single tube, a cell-free nucleic acid, a modified reverse transcriptase enzyme, a template, nucleotides, an acceptor nucleic acid molecule, a catalytic metal, and one or more primer(s), under conditions sufficient to generate a library. In some embodiments, the modified reverse transcriptase comprises at least one improved enzyme property relative to a wild type or unmodified reverse transcriptase.

In some embodiments, the nucleic acid molecule comprises an unknown nucleic acid sequence. In some embodiments, the template comprises an unknown nucleic acid sequence. In some embodiments, the migration from the template to the acceptor nucleic acid molecule is independent of sequence identity between the template and the acceptor nucleic acid molecule. In some embodiments, the acceptor nucleic acid molecule comprises a modified nucleotide that may cause primer extension to stop. In some embodiments, the cell-free nucleic acid is cell-free DNA (cfDNA), circulating tumor DNA (ctDNA), and/or formalin-fixed, paraffin-embedded DNA (FFPE DNA), or combinations thereof.

In some embodiments, a hot start thermostable polymerase may be added to a method of the present disclosure at or prior to any step of the method and/or at the same time that a mixing step takes place. For example, a hot start thermostable polymerase may be added at the same time that the modified reverse transcriptase is added to the reaction. The hot start thermostable polymerase may be added at the same time that the acceptor nucleic acid molecule is added, and/or at the same time that the template, and/or primer, and/or reverse transcriptase, and/or nucleotides is added to the reaction tube. In some embodiments, the hot start thermostable polymerase is added prior to the start of the PCR reaction. In some embodiments, the hot start thermostable polymerase is added prior to or at the same time as the RT reaction. In some embodiments, the hot start thermostable polymerase is hot start taq polymerase. Amplification of target nucleic acids can occur on a bead. In some embodiments, amplification does not occur on a bead. Amplification can be by isothermal amplification, e.g., isothermal linear amplification. In some embodiments, a hot start PCR can be performed wherein the reaction is heated to 95° C. e.g., for two minutes prior to addition of a polymerase or the polymerase can be kept inactive until a first heating step in cycle 1. Hot start PCR can be used to minimize nonspecific amplification.

In some embodiments, the method of the present disclosure is performed in a single tube. In some embodiments, all the steps of the method of the present disclosure is performed in a single tube. In some embodiments, the method (from start to finish) is performed in a single tube. In some embodiments, the same tube used for the RT reaction is used for the PCR amplification reaction.

In some embodiments, the PCR amplification is performed at a temperature sufficient to inactivate the reverse transcriptase enzyme. In some embodiments, the PCR amplification is performed at a temperature sufficient to activate the hot start thermostable polymerase.

The present disclosure relates to methods of amplifying a cell-free nucleic acid molecule from a sample. In some embodiments, the sample is a biological sample. In some embodiments, the cell-free nucleic acid molecule is subjected to nucleic acid amplification comprising a reverse transcriptase (e.g., modified reverse transcriptase). In some embodiments, the cell-free nucleic acid molecule is subjected to nucleic acid amplification comprising a reverse transcriptase (e.g., modified reverse transcriptase) under conditions that amplify the nucleic acid molecule at a specified processivity. In some embodiments the processivity is of at least about 80% per base, at least about 81% per base, at least about 82% per base, at least about 83% per base, at least about 84% per base, at least about 85% per base, at least about 86% per base, at least about 87% per base, at least about 88% per base, at least about 89% per base, at least about 90% per base, at least about 91% per base, at least about 92% per base, at least about 93% per base, at least about 94% per base, at least about 95% per base, at least about 96% per base, at least about 97% per base, at least about 98% per base, at least about 991% per base, or at least about 100% per base. In some embodiments, the processivity is performed at a temperature of about or at most about or at least about 12° C., of about or at most about or at least about 13°, of about or at most about or at least about 14° C., of about or at most about or at least about 15° C., of about or at most about or at least about 16° C., of about or at most about or at least about 17° C., of about or at most about or at least about 18° C., of about or at most about or at least about 19° C., of about or at most about or at least about 20° C., of about or at most about or at least about 21° C., of about or at most about or at least about 22° C., of about or at most about or at least about 23° C., of about or at most about or at least about 24° C., of about or at most about or at least about 25° C., of about or at most about or at least about 26° C., of about or at most about or at least about 27° C. of about or at most about or at least about 28° C. of about or at most about or at least about 29° C., of about or at most about or at least about 30° C., of about or at most about or at least about 31° C., of about or at most about or at least about 32° C., of about or at most about or at least about 33° C. of about or at most about or at least about 34° C., of about or at most about or at least about 35° C., of about or at most about or at least about 36° C., of about or at most about or at least about 37° C., of about or at most about or at least about 38° C., of about or at most about or at least about 39° C., of about or at most about or at least about 40° C., of about or at most about or at least about 45° C., of about or at most about or at least about 50° C., of about or at most about or at least about 60° C., of about or at most about or at least about 70° C., of about or at most about or at least about 80° C., of about or at most about or at least about 8° C. In some embodiments the processivity is of at least about 80% per base, at least about 81% per base, at least about 82% per base, at least about 83% per base, at least about 84% per base, at least about 85% per base, at least about 86% per base, at least about 87% per base, at least about 88% per base, at least about 89% per base, at least about 90% per base, at least about 91% per base, at least about 92% per base, at least about 93% per base, at least about 94% per base, at least about 95% per base, at least about 96% per base, at least about 97% per base, at least about 98% per base, at least about 99% per base, or at least about 100% per base, at a temperature of about or at most about or of at least about 30° C., or of about or at most about or of at least about 12° C., of about or at most about or of at least about 45° C., of about or at most about or of at least about 35° C. In some embodiments, the reverse transcriptase is a non-LTR retrotransposon or a modified non-LTR retrotransposon. In some embodiments, the reverse transcriptase is an R2 reverse transcriptase or a modified R2 reverse transcriptase. In some embodiments, the reverse transcriptase is an R2 non-LTR retrotransposon or a modified R2 non-LTR retrotransposon.

The present disclosure relates to methods for preparing a complementary deoxyribonucleic acid (cDNA) library and/or a DNA library from a plurality of single cells. In some embodiments, the method comprises the steps of: releasing nucleic acid from each single cell to provide a plurality of individual nucleic acid samples. In some embodiments, the nucleic acid in each individual nucleic acid sample is from a single cell. In some embodiments, the method further comprises annealing the nucleic acid template to one or more primer(s). In some embodiments, the method further comprises mixing the nucleic acid template annealed to one or more primer(s) with an acceptor template (or an acceptor nucleic acid molecule) and a modified reverse transcriptase, in the presence of nucleotides, under conditions effective for producing a cDNA and/or a DNA molecule. In some embodiments, the modified reverse transcriptase is capable of template jumping and/or comprises at least one improved enzyme property relative to a wild type or unmodified reverse transcriptase. In some embodiments, the method further comprises amplifying the cDNA molecule and/or DNA molecule to generate a cDNA and/or DNA library.

The present disclosure relates to methods of detecting a nucleic acid molecule. In some embodiments, the method comprises mixing a sample comprising a nucleic acid molecule with an acceptor template (or an acceptor nucleic acid molecule), a modified reverse transcriptase, a primer, and nucleotides, under conditions effective for generating a nucleic acid molecule. In some embodiments, the modified reverse transcriptase comprises at least one improved enzyme property relative to a wild type or unmodified reverse transcriptase. In some embodiments, the acceptor template (or an acceptor nucleic acid molecule) comprises at least one modified nucleotide. In some embodiments, the modified nucleotide may cause primer extension to stop. In some embodiments, the method further comprises amplifying the nucleic acid molecule.

The present disclosure relates to methods of detecting, diagnosing, and/or prognosing a disease (e.g., cancer) in a subject comprising: (a) obtaining sequence information of a nucleic acid sample (e.g., a cell-free nucleic acid sample) derived from a subject and (b) using the sequence information derived from step (a) to detect circulating tumor nucleic acid in the sample. In some embodiments, obtaining sequence information according to step (a) comprises using one or more adaptor(s). In some embodiments, the one or more adaptor(s) comprises a molecular barcode. An adaptor can comprise one or more end modifications. An adaptor can comprise one 5' phosphate. An adaptor can comprise two 5' phosphates. An adaptor can comprise one 3' hydroxyl. An adaptor can comprise two 3' hydroxyls. An adaptor can lack a 3' hydroxyl.

In some embodiments, the molecular barcode comprises a randomer sequence. In some embodiments, the method is capable of detecting cell-free nucleic acid that is less than or equal to about 0.75%, 0.50%, 0.25%, 0.1%, 0.9%, 0.8%, 0.7%, 0.6%, 0.5%, 0.4%, 0.3%, 0.2%, 0.1%, 0.05%, 0.01%, 0.009%, 0.008%, 0.007%, 0.006%, 0.005%, 0.004%, 0.003%, 0.002%, 0.001%, 0.0005%, or 0.00001%, 1%, 1.75%, 1.5%, 1.25%, 2%, 3%, 4%, 5%, 6%, 8%, 9%, 10%, 11%, 12%, 13%, 14% 15%, 16%, 17%, 18%, 19%, 20%, 22%, 25%, 27%, 30%, 32%, 35%, 40%, 45%, 50%, 55%, 60%, 65%, 70%, 75%, 80%, 85%, 90%, 95%, or 100% of total cell-free nucleic acid. In some embodiments, the method is capable of detecting circulating tumor nucleic acid that is less than or equal to about 0.75%, 0.50%, 0.25%, 0.1%, 0.9%, 0.8%, 0.7%, 0.6%, 0.5%, 0.4%, 0.3%, 0.2%, 0.1%, 0.05%, 0.01%, 0.009%, 0.008%, 0.007%, 0.006%, 0.005%, 0.004%, 0.003%, 0.002%, 0.001%, 0.0005%, or 0.00001%, 1%, 1.75%, 1.5%, 1.25%, 2%, 3, 4%, 5%, 6%, 8%, 9%, 10%, 11%, 12%, 13%, 14% 15%, 16%, 17%, 18%, 19%, 20%, 22%, 25%, 27%, 30%, 32%, 35%, 40%, 45%, 50%, 55%, 60%, 65%, 70%, 75%, 80%, 85%, 90%, 95%, or 100% of total circulating nucleic acid. In some embodiments, the method is capable of detecting a percentage of circulating tumor nucleic acid (ct nucleic acid) that is less than or equal to 1.75%, 1.5%, 1.25%, 1%, 0.75%, 0.50%, 0.25%, 0.1%, 0.9%, 0.8%, 0.7%, 0.6%, 0.5%, 0.4%, 0.3%, 0.2%, 0.1%, 0.05%, 0.01%, 0.009%, 0.008%, 0.007%, 0.006%, 0.005%, 0.004%, 0.003%, 0.002%, 0.001%, 0.0005%, or 0.00001% of the total cell-free nucleic acid. In some embodiments, the sequence information comprises information related to at least about 1, 2, 3, 4, 5, 6, 7, 8, 9, 10, 15, 20, 25, 30, 35, 40, 50, 70, 80, 100, 200, or 300 genomic regions. In some embodiments, the sequence information comprises information related to partially all, mostly all, or all genome sequencing. In some embodiments, concentrations as low as 50 ng of cfDNA may provide for full genome sequencing.

In some embodiments, the method of the present disclosure may be used to determine the presence of a disease (e.g., cancer) in a subject. In some embodiments, determining the presence of cancer in a subject comprises obtaining a sample from a subject and detecting a nucleic acid molecule (e.g., nucleic acid fragment) in the sample according to any of the methods described herein. In some embodiments, determining the presence of a disease (e.g., cancer) in a subject comprises amplifying and/or sequencing the nucleic acid molecule. In some embodiments, the presence of a nucleic acid molecule is indicative of cancer. In some embodiments, the presence of a nucleic acid molecule is indicative of a prenatal condition. In some embodiments, the nucleic acid molecule and/or template comprises an unknown sequence. In some embodiments, the sample is a biological sample. In some embodiments, the biological sample comprises circulating tumor DNA. In some embodiments, the biological sample comprises a tissue sample.

In some embodiments, the method of the present disclosure comprises detecting an amplicon generated by the amplification primers, wherein the presence of the amplicon determines whether the modified reverse transcriptase is present in the sample.

In some embodiments, the method of the present disclosure comprises providing a prenatal diagnosis based on the presence or absence of a nucleic acid molecule (e.g., cDNA molecule).

The present disclosure relates to a kit of producing a nucleic acid molecule (e.g., cDNA molecule) comprising: one or more primer(s), nucleotides, at least one modified reverse transcriptase, a template, and instructions for performing any of the methods disclosed in the present disclosure. In some embodiments, a kit can be used for detecting nucleic acid comprising a nucleic acid template (e.g., a DNA template), at least one modified reverse transcriptase, nucleotides, and instructions for performing any of the methods disclosed in the present disclosure. In some embodiments, the modified reverse transcriptase present in the kit or to be used with the kit has activity and/or is capable of template jumping at a temperature equal to or less than about or more than about 4° C. 8° C., 12° C., 13° C., 14° C., 15° C., 16° C., 17° C. 18° C., 19° C., 20° C., 21° C., 22° C., 23° C., 24° C., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 45° C., 46° C., 47° C., 48° C., 49° C., 50° C., 52° C., 55° C., or 60° C. In some embodiments, the nucleic acid and/or the template (e.g., nucleic acid template, DNA, or RNA) is present at a concentration as low as about 50 femtomolar, as low as about 60 femtomolar, as low as about 70 femtomolar, as low as about 75 femtomolar, as low as about 80 femtomolar, as low as about 90 femtomolar, as low as about 100 femtomolar, as low as about 120 femtomolar, as low as about 150 femtomolar, as low as about 200 femtomolar, as low as about 250 femtomolar, as low as about 300 femtomolar, as low as about 350 femtomolar, as low as about 400 femtomolar, as low as about 500 femtomolar, as low as about 550 femtomolar, as low as about 600 femtomolar, as low as about 700 femtomolar, or as low as about 800 femtomolar. In some embodiments, a kit may comprise one or more primer(s), and/or a template annealed to a primer. The present disclosure also relates to a kit of producing modified enzymes, modified reverse transcriptases, or modified polypeptides. In some embodiments, the kit includes a PCR step and/or components to use for PCR.

In some embodiments, the present disclosure relates to a kit for detecting nucleic acid comprising a template, at least one modified reverse transcriptase, nucleotides, and instructions to perform the method of the present disclosure. In some embodiments, the nucleic acid is present at a concentration of at least about 50 femtomolar, at least about 20 femtomolar, at least about 100 femtomolar, or greater than about 1000 femtomolar.

The present disclosure relates to any method disclosed herein wherein the methods may further comprise detecting at least one amplicon generated by the amplification primers. In some embodiments, the presence of at least one amplicon indicates the presence of at least one modified reverse transcriptase in a sample.

In some embodiments, any of the methods of the present disclosure does not comprise a purification step. In some embodiments, any of the methods of the present disclosure comprises at least one purification step. In some embodiments, any of the methods of the present disclosure comprises at least two purification steps. In some embodiments, any of the methods of the present disclosure comprises at least three, at least four, at least five, at least six, at least seven, at least eight, at least nine, at least ten, at least fifteen, or at least twenty purification steps.

The present disclosure relates to a method for preparing a library for sequencing.

In some embodiments, the modified reverse transcriptase is a modified non-retroviral reverse transcriptase. In some embodiments, the modified reverse transcriptase is a modified non-LTR retrotransposon. In some embodiments, the modified reverse transcriptase is a modified R2 reverse transcriptase.

In some embodiments, the variants or modified enzymes or non-naturally occurring enzymes or modified polypeptides have/has improved enzyme property compared to the unmodified, wild type or naturally occurring enzyme or polypeptide. In some embodiments, the improved enzyme property is selected from at least one of the following: increased stability (e.g., increased thermostability), increased specific activity, increased protein expression, improved purification, improved processivity, improved strand displacement, increased template jumping, and improved fidelity. In some embodiments, the term stability may include, but it is not limited to, thermal stability, storage stability, and pH stability. In some embodiments, specific activity is a measurement of the enzymatic activity (in units) of the protein or enzyme relative to the total amount of protein or enzyme used in a reaction. In some embodiments, specific activity is measured based on the ability of the enzyme to produce cDNA molecule. In some embodiments, the specific activity is measured in U/mg protein determined based on a primer extension reaction. In some embodiments, the altered or improved property may be characterized by a Performance Index (PI), where the P1 is a ratio of performance of the variant, the modified enzyme, or the non-naturally occurring enzyme compared to the wild-type or compared to a naturally occurring enzyme or protein. The term "performance index (PI)" may refer to the ratio of performance of a variant polypeptide to a parent polypeptide or of a modified enzyme to an unmodified enzyme (e.g., reverse transcriptase) or of a non-naturally occurring enzyme to a naturally-occurring enzyme for a specified performance characteristic. In some embodiments, the specified performance or enzyme property characteristic may include, but is not limited to, stability (e.g., thermostability), specific activity, protein expression, purification, processivity, strand displacement, end-to-end template jumping, and/or fidelity. In some embodiments, the PI is greater than about 0.5, while in other embodiments, the PI is about 1 or is greater than about 1. In some embodiments, the variant polypeptide, modified enzyme (e.g., modified reverse transcriptase), or the non-naturally occurring enzyme comprises a modification at one or more amino acid positions. In some embodiments, the modified enzyme or the non-naturally occurring enzyme has a performance index (PI) that is equal to or greater than about 0.1, equal to or greater than about 0.2, equal to or greater than about 0.3, equal to or greater than about 0.4, equal to or greater than about 0.5, equal to or greater than about 0.6, equal to or greater than about 0.7, equal to or greater than about 0.8, equal to or greater than about 0.9, equal to or greater than about 1, equal to or greater than about 1.2, equal to or greater than about 1.5, equal to or greater than about 2, equal to or greater than about 2.5, equal to or greater than about 3, equal to or greater than about 3.5, equal to or greater than about 4, equal to or greater than about 4.5, equal to or greater than about 5, equal to or greater than about 5.5, equal to or greater than about 6, equal to or greater than about 6.5, equal to or greater than about 7, equal to or greater than about 8, equal to or greater than about 9, equal to or greater than about 10, equal to or greater than about 50, equal to or greater than about 75, equal to or greater than about 100, equal to or greater than about 500, equal to or greater than about 1000. In some embodiments, the variant or modified enzyme has a performance index (PI) from about 0.1 to about 1, from about 0.5 to about 1, from about 0.1 to about 2, from about 1 to about 2, from about 0.5 to about 2, from about 0.5 to about 10, from about 1 to about 10, from about 0.1 to about 10, from about 1 to about 5, from about 0.5 to about 5, from about 0.5 to about 20, from about 0.3 to about 20, from about 5 to about 10, from about 1.5 to about 10, from about 1.5 to about 50, from about 1 to about 50, from about 1.5 to about 100, from about 1.5 to about 75, from about 4 to about 10, from 3 to about 10, from about 3 to about 25, from about 3 to about 50, from about 2 to about 20, from about 2 to about 100, from about 2 to about 1000, from about 1 to about 1000. In some embodiments, the performance index is determined for protein expression. In some embodiments, the performance index is determined for at least one characteristic that improves enzyme property. In some embodiments, the performance index is determined for purification. In some embodiments, the performance index is determined for stability (e.g., thermostability). In some embodiments, the performance index is determined for specific activity. In some embodiments, the performance index is determined for processivity. In some embodiments, the performance index is determined for strand displacement. In some embodiments, the performance index is determined for template jumping. In some embodiments, the performance index is determined for fidelity. In some embodiments, the characteristic that improves enzyme property is selected from the group consisting of increased thermal stability, increased specific activity, and increased protein expression. In some embodiments, the performance index is performed at 30° C. In some embodiments, the enzyme property is analyzed at 30° C. In some embodiments, the enzyme property, stability (e.g., thermostability), specific activity, protein expression, purification, processivity, strand displacement, template jumping, and/or fidelity is performed at 30° C. In some embodiments, the performance index for measuring enzyme property, is performed at a specific temperature. In some embodiments, the temperature is from about 25° C. to about 42° C. In some embodiments, the temperature is from about 8° C. to about 50° C. In some embodiments, the performance index for measuring enzyme property may be carried out at a temperature ranging from about from about 8° C. to about 50° C., from about 12° C. to about 42° C., 25° C. to about 42° C., from about 25° C. to about 40° C., from about 28° C. to about 38° C., from about 30° C. to about 38° C., from about 35° C. to about 37° C., from about 27° C. to about 38° C., from about 27° C. to about 37° C., from about 26° C. to about 42° C., from about 25° C. to about 38° C., from about 27° C. to about 38° C., from about 29° C. to about 38° C., from about 29° C. to about 32° C. In some embodiments, the performance index for measuring enzyme property may be carried out at a temperature that is equal to or lower than about 8° C., equal to or lower than about 12° C., equal to or lower than about 20° C., equal to or lower than about 4° C., equal to or lower than about 55° C., equal to or lower than about 37° C., equal to or lower than about 25° C., equal to or lower than about 28° C., equal to or lower than about 30° C., equal to or lower than about 32° C., equal to or lower than about 34° C., equal to or lower than about 35° C., equal to or lower than about 36° C., equal to or lower than about 33° C. equal to or lower than about 31° C., equal to or lower than about 60° C., equal to or lower than about 38° C., equal to or lower than about 39° C., equal to or lower than about 40° C., equal to or lower than about 41° C., equal to or lower than about 42° C., equal to or lower than about 50° C. In some embodiments, the temperature may range from about 25° C. to about 80° C.

In some embodiments, the specific activity of the modified enzyme is from about 5 units/mg to about 140,000 units/mg, from about 5 units/mg to about 125,000 units/mg, from about 50 units/mg to about 100,000 units/mg, from about 100 units/mg to about 100,000 units/mg, from about 250 units/mg to about 100,000 units/mg, from about 500 units/mg to about 100,000 units/mg, from about 1000 units/mg to about 100,000 units/mg, from about 5000 units/mg to about 100,000 units/mg, from about 10,000 units/mg to about 100,000 units/mg, from about 25,000 units/mg to about 75,000 units/mg. In some embodiments, the ranges of specific activities include a specific activity of from about 20,000 units/mg to about 140.000 units/mg, a specific activity from about 20,000 units/mg to about 130,000 units/mg, a specific activity from about 20,000 units/mg to about 120,000 units/mg, a specific activity from about 20,000 units/mg to about 110,000 units/mg, a specific activity from about 20,000 units/mg to about 100,000 units/mg, a specific activity from about 20,000 units/mg to about 90.000 units/mg, a specific activity from about 25,000 units/mg to about 140,000 units/mg, a specific activity from about 25,000 units/mg to about 130,000 units/mg, a specific activity from about 25,000 units/mg to about 120,000 units/mg, a specific activity from about 25,000 units/mg to about 110,000 units/mg, a specific activity from about 25,000 units/mg to about 100,000 units/mg, and a specific activity from about 25,000 units/mg to about 90,000 units/mg. In some embodiments, the lower end of the specific activity range may vary from 30,000, 35,000, 40,000, 45,000, 50,000, 55,000, 60,000, 65,000, 70,000, 75,000, and 80,000 units/mg. In some embodiments, the upper end of the range may vary from 150,000, 140,000, 130,000, 120,000, 110,000, 100,000, and 90,000 units/mg.

In some embodiments, the sample is a biological sample. In some embodiments, the biological sample comprises a circulating tumor DNA. In some embodiments, the biological sample comprises a tissue sample. In some embodiments, the nucleic acid is from a sample. In some embodiments, the sample is a liquid biopsy sample. In some embodiments, a sample may be an RNA sample. In some embodiments, an RNA sample may be used for various purposes, including but not limited to PCR ligation, transcriptome analysis, microarray analysis, northern analysis, and cDNA library construction. In some embodiments, the present disclosure is directed to methods for amplifying cDNA libraries from low quantities of cells and/or single cells in suitable quantity and quality for transcriptome analysis through, for example, sequencing or microarray analysis.

In some embodiments, the nucleic acid and/or a template is of an unknown sequence. In some embodiments, the nucleic acid and/or a template is RNA, DNA, or a combination of RNA and DNA. In some embodiments, the RNA is mRNA. In some embodiments, the mRNA comprises internal priming. In some embodiments, the nucleic acid may be a fragmented nucleic acid and/or a degraded nucleic acid. In some embodiments, the template may be a fragmented template and/or a degraded template. In some embodiments, the nucleic acid may be a non-fragmented nucleic acid and/or a non-degraded nucleic acid. In some embodiments, the template may be a non-fragmented template and/or a non-degraded template. In some embodiments, the nucleic acid and/or template is indicative of a disease. In some embodiments, the nucleic acid and/or template is indicative of cancer. In some embodiments, the nucleic acid is equal to or less than about 0.01 micromolar. In some embodiments, the nucleic acid is between about 0.1 nM to about 100 nM. In some embodiments, the nucleic acid is equal to or less than about 500 femtomolar.

In some embodiments, the RNA is obtained from a source selected from the group consisting of single cells, cultured cells, tissues, RNA transcription-based amplified RNA (such as TTR-amplified RNA or other DNA-dependent RNA polymerase transcribed RNA), RNA-promoter-driven transcribed RNA, aRNA, aRNA-amplified RNA, single-cell mRNA library, isolated mRNA. RNA contained within cells, and combinations of RNA sources. In some embodiments, the RNA is prepared from a plurality of fixed cells, wherein said fixed cells are protected from RNA degradation and also subjected to permeabilisation for enzyme penetration. In some embodiments, the fixed cells are obtained from fixative-treated cultural cells, frozen fresh tissues, fixative-treated fresh tissues or paraffin-embedded tissues on slides.

In some embodiments, the RNA molecule can be the product of in vitro synthesis or can have been isolated from cells or tissues (Ausubel, et. al., Short Protocols in Molecular Biology, 3rd ed., Wiley, 1995). Cells and tissues suitable for use in obtaining RNA useful in the practice of the present disclosure may include both animal cells and plant cells. In some embodiments, the cells include mammalian cells and insect cells. RNA may also be isolated from prokaryotic cells such as bacteria.

In some embodiments, the template is RNA, DNA, or a combination of RNA and DNA. In some embodiments, the template may be a fragmented template and/or a degraded template. In some embodiments, the template is not degraded and/or fragmented. In some embodiments, the RNA is mRNA. In some embodiments, the template is an RNA template. In some embodiments, the template is a DNA template. In some embodiments, the template is a DNA and/or RNA template. In some embodiments, the template is a mixture of DNA and RNA. In some embodiments, the RNA comprises any type of RNA (e.g., one or more of rRNA, tRNA, mRNA, and/or snRNA). In some embodiments the RNA comprises a mixture of at least one type of RNA. In some embodiments, the DNA can comprise a mixture of, or at least one of, genomic DNA or nuclear DNA, mitochondrial DNA, Y-line DNA, autosomal DNA, ribosomal DNA, or a combination thereof. In some embodiments, the template is a polymer of any length. In some embodiments, the template is from about 20 bases to about 100 bases, from about 30 bases to about 500 bases, from about 30 bases to about 1000 bases, from about 50 bases to about 300 bases, about 100 bases to about 600 bases, about 200 bases to about 800 bases, about 200 bases to about 600 bases, about 100 bases to about 2000 bases, about 100 bases and about 2500 bases, about 200 bases to about 5000 bases, about 200 bases to about 1000 bases, about 200 to about 10000 bases. In some embodiments, the template is at least about 10 bases, at least about 20 bases, at least about 30 bases, at least about 40 bases, at least about 50 bases, at least about 60 bases, at least about 70 bases, at least about 80 bases, at least about 90 bases, at least about 100 bases, at least about 150 bases, at least about 200 bases, at least about 250 bases, at least about 300 bases, at least about 350 bases, at least about 400 bases, at least about 450 bases, at least about 500 bases, at least about 550 bases, at least about 600 bases, at least about 650 bases, at least about 700 bases, at least about 750 bases, at least about 800 bases, at least about 850 bases, at least about 900 bases, at least about 950 bases, at least about 1000 bases, at least about 1100 bases, at least about 1200 bases, at least about 1300 bases, at least about 1400 bases, at least about 1500 bases, at least about 1700 bases, at least about 2000 bases, at least about 2200 bases, at least about 2500 bases, at least about 2700 bases, at least about 3000, at least about 3500 bases, at least about 4000 bases, at least about 4500 bases, at least about 5000 bases, at least about 10,000 bases, or at least about 50,000 bases. In some embodiments, the template is about or at least about or at most about 10 bases, about or at least about or at most about 20 bases, about or at least about or at most about 30 bases, about or at least about or at most about 40 bases, about or at least about or at most about 50 bases, about or at least about or at most about 60 bases, about or at least about or at most about 70 bases, about or at least about or at most about 80 bases, about or at least about or at most about 90 bases, about or at least about or at most about 100 bases, about or at least about or at most about 150 bases, about or at least about or at most about 200 bases, about or at least about or at most about 250 bases, about or at least about or at most about 300 bases, about or at least about or at most about 350 bases, about or at least about or at most about 400 bases, about or at least about or at most about 450 bases, about or at least about or at most about 500 bases, about or at least about or at most about 550 bases, about or at least about or at most about 600 bases, about or at least about or at most about 650 bases, about or at least about or at most about 700 bases, about or at least about or at most about 750 bases, about or at least about or at most about 800 bases, about or at least about or at most about 850 bases, about or at least about or at most about 900 bases, about or at least about or at most about 950 bases, about or at least about or at most about 1000 bases, about or at least about or at most about 1100 bases, about or at least about or at most about 1200 bases, about or at least about or at most about 1300 bases, about or at least about or at most about 1400 bases, about or at least about or at most about 1500 bases, about or at least about or at most about 1700 bases, about or at least about or at most about 2000 bases, about or at least about or at most about 2200 bases, about or at least about or at most about 2500 bases, about or at least about or at most about 2700 bases, about or at least about or at most about 3000, about or at least about or at most about 3500 bases, about or at least about or at most about 4000 bases, about or at least about or at most about 4500 bases, about or at least about or at most about 5000 bases, about or at least about or at most about 10,000 bases, or about or at least about or at most about 50,000 bases. In some embodiments, the template DNA may be a double-stranded DNA template (dsDNA template) or a single-stranded DNA template (ssDNA template). In some embodiments, the template RNA may be a double-stranded RNA template (dsRNA template) or a single-stranded RNA template (ssRNA template).

In some embodiments, the template is from a single cell. In some embodiments, the template is from a plurality of cells. In some embodiments, the template comprises low copy number DNA, or RNA, or a combination of DNA and/or RNA. In some embodiments, low copy number refers to samples that contain equal to or less than about 250 picograms (e.g. 100 picograms) of for example the template and/or DNA and/or RNA and/or a mixture of DNA and RNA. In some embodiments, the RNA can comprise at least one of messenger RNA (mRNA), transfer RNA, transfer-messenger RNA, ribosomal RNA, antisense RNA, small nuclear RNA (snRNA), small nucleolar RNA (snoRNA), micro-RNA (miRNA), small interfering RNA (siRNA), or any combination thereof. In some embodiments, the template is from a sample. In some embodiments, the total amount of template is the total amount of template in a sample. In some embodiments, the total amount of template is the total amount of template in a reaction mixture. In some embodiments, the total amount of template is the total amount of template in one pot (e.g., single vessel). In some embodiments, the total amount of the template is from about 1 femtomolar (fM) to about 100 micromolar, from about 40 femtomolar to about 0.01 micromolar, from about 50 femtomolar to about 500 femtomolar, from about 50 femtomolar to about 0.01 micromolar, from about 50 femtomolar to about 0.1 micromolar, from about 50 femtomolar to about 500 picomolar, from about 50 femtomolar to about 500 nanomolar, from about 50 femtomolar to about 500 micromolar, from about 50 femtomolar to about 1 picomolar, from about 40 femtomolar to about 1 nanomolar, from about 1 femtomolar to about 1 picolomar, from about 0.0001 micromolar to about 0.01 micromolar, from about 0.0001 micromolar to about 0.1 micromolar, or from about 0.1 nM to about 0 nM. In some embodiments, the total about of template is equal to or at least about or lower than about 1000 micromolar, equal to or at least about or lower than about 500 micromolar, equal to or at least about or lower than about 250 micromolar, equal to or at least about or lower than about 100 micromolar, equal to or at least about or lower than about 50 micromolar, equal to or at least about or lower than about 25 micromolar, equal to or at least about or lower than about 10 micromolar, equal to or at least about or lower than about 1 micromolar, equal to or at least about or lower than about 0.1 micromolar, equal to or at least about or lower than about 0.01 micromolar, equal to or at least about or lower than about 0.001 micromolar, equal to or at least about or lower than about 0.0001 micromolar, equal to or at least about or lower than about 2000 nanomolar, equal to or at least about or lower than about 500 nanomolar, equal to or at least about or lower than about 250 nanomolar, equal to or at least about or lower than about 200 nanomolar, equal to or at least about or lower than about 50 nanomolar, equal to or at least about or lower than about 25 nanomolar, equal to or at least about or lower than about 20 nanomolar, equal to or at least about or lower than about 2 nanomolar, equal to or at least about or lower than about 0.2 nanomolar, equal to or at least about or lower than about 0.01 nanomolar, equal to or at least about or lower than about 0.001 nanomolar, equal to or at least about or lower than about 0.0001 nanomolar, equal to or at least about or lower than about 3000 picomolar, equal to or at least about or lower than about 500 picomolar, equal to or at least about or lower than about 250 picomolar, equal to or at least about or lower than about 300 picomolar, equal to or at least about or lower than about 50 picomolar, equal to or at least about or lower than about 25 picomolar, equal to or at least about or lower than about 30 picomolar, equal to or at least about or lower than about 3 picomolar, equal to or at least about or lower than about 0.3 picomolar, equal to or at least about or lower than about 0.01 picomolar, equal to or at least about or lower than about 0.001 picomolar, equal to or at least about or lower than about 0.0001 picomolar, equal to or at least about or lower than about 5000 femtomolar, equal to or at least about or lower than about 500 femtomolar, equal to or at least about or lower than about 250 femtomolar, equal to or at least about or lower than about 50 femtomolar, equal to or at least about or lower than about 25 femtomolar, equal to or at least about or lower than about 10 femtomolar, equal to or at least about or lower than about 1 femtomolar, equal to or at least about or lower than about 0.1 femtomolar, equal to or at least about or lower than about 0.01 femtomolar, equal to or at least about or lower than about 0.001 femtomolar, equal to or at least about or lower than about 0.0001 femtomolar.

In some embodiments, the template may be present in any nucleic acid sample of interest, including but not limited to, a nucleic acid sample isolated from a single cell, a plurality of cells (e.g., cultured cells), a tissue, an organ, or an organism (e.g., bacteria, yeast, or the like). In some embodiments, the nucleic acid sample is isolated from a cell(s), tissue, organ, and/or the like of a mammal (e.g., a human, a rodent (e.g., a mouse), or any other mammal of interest). In some embodiments, the nucleic acid sample is isolated from a source other than a mammal, such as bacteria, yeast, insects (e.g., *drosophila*), amphibians (e.g., frogs (e.g., *Xenopus*)), viruses, plants, or any other non-mammalian nucleic acid sample source.

In some embodiments, the template is optimized. In some embodiments, the acceptor template or acceptor nucleic acid molecule comprises at least one modified nucleotide. In some embodiments, the acceptor template or acceptor nucleic acid molecule is engineered to improve template jumping and/or conversion efficiency. In some embodiments, the acceptor template or acceptor nucleic acid molecule is optimized at the 3'-end. In some embodiments, the optimization prevents secondary structure formation and/or nucleotide composition.

In some embodiments, the methods disclosed in the present disclosure may further comprise optimization of the template (e.g. donor template). In some embodiments, optimization of the template comprises contacting the template (e.g. RNA) with an agent capable of removing the 5' cap structure of the template (e.g., mRNA). In some embodiments, the removal of the cap structure is performed under conditions permitting the removal of the cap structure by the agent. In some embodiments, the methods disclosed in the present disclosure further include dephosphorylation of for example, the decapped template. In some embodiments, the method further includes adding a dephosphorylating agent to the decapped template under conditions permitting dephosphorylation.

In some embodiments, any method of the present disclosure may further comprise optimization of the template. In some embodiments, optimization of the template comprises: contacting a sample comprising a template with an agent that removes a 5' cap structure of the template, under conditions permitting the removal of the cap structure by the agent. In some embodiments, the optimization of the template may further comprise adding a dephosphorylating agent under conditions permitting the dephosphorylation of the decapped template by the agent. In some embodiments, the template (e.g. RNA molecule) is dephosphorylated after synthesis or isolation. In some embodiments, the dephosphorylation is achieved by treatment of the nucleic acid (e.g., RNA) molecule with alkaline phosphatase. In some embodiments, the isolated donor template, such as RNA or mRNA, is decapped and dephosphorylated after isolation. Methods of decapping nucleic acids (e.g., RNAs) include both enzymatic methods (such as by using a pyrophosphatase such as tobacco pyrophosphatase) and chemical methods (such as periodate oxidation and beta elimination). Methods for dephosphorylation of nucleic acid (e.g., RNA) may use alkaline phosphatase. In some embodiments, the isolated mRNA is decapped (using tobacco acid pyrophosphatase, for example) and dephosphorylated (e.g., by using alkaline phosphatase). In some embodiments, the removal of the RNA cap structure is by either enzymatic treatment of the mRNA with a pyrophosphatase or chemical decapping (e.g., by periodate oxidation and beta elimination). In some embodiments, the mRNA is modified with a tag.

In some embodiments, any of the methods of the present disclosure is carried out in one-pot (e.g., single vessel). In some embodiments, the reactions are carried out in a one-pot (e.g., single vessel). In some embodiments, the reaction is a one-pot (e.g., single vessel) reaction.

In some embodiments, template jumping is dependent on the concentration of the acceptor nucleic acid molecule.

In some embodiments, the modified enzyme (e.g., modified reverse transcriptase), modified reverse transcriptase, non-naturally occurring enzyme, modified polypeptide having reverse transcriptase activity comprises at least one modification relative to the wild type, unmodified counterpart, or naturally occurring enzyme. In some embodiments, the modified non-LTR retrotransposon comprises at least one modification of a wild-type or unmodified non-LTR retrotransposon. In some embodiments, the modified R2 reverse transcriptase comprises at least one modification of a wild-type or unmodified R2 reverse transcriptase. In some embodiments, the modified reverse transcriptase comprises at least one modification of a wild-type or unmodified reverse transcriptase. In some embodiments, the modified polypeptide having reverse transcriptase activity comprises at least one modification of a wild-type or unmodified polypeptide having reverse transcriptase activity. In some embodiments, the modification comprises at least one truncation (e.g., N-terminal truncation, C-terminal truncation, and/or N- and C-terminal truncations). In some embodiments, the modification comprise(s) site-specific incorporation, and/or addition, and/or deletion, and/or substitution of amino acid(s) at positions of interest. In some embodiments, the modification enhances the biological properties of the modified enzyme or modified polypeptide relative to the wild-type or unmodified enzyme or polypeptide. In some embodiments, the modification improves at least one enzyme property of the modified enzyme or polypeptide relative to the wild-type or unmodified enzyme or polypeptide. In some embodiments, the modification(s) serve as a point of attachment for, e.g., labels and protein half-life extension agents, and for purposes of affixing the variants to the surface of a solid support. In some embodiments, the present disclosure is related to methods of producing cells capable of producing the modified enzymes (e.g., modified reverse transcriptase) or modified polypeptides, and of producing vectors containing DNA or RNA encoding the modified enzymes (e.g., modified reverse transcriptase) or modified polypeptides. In some embodiments, the truncation is based on a two-step process. In some embodiments, the first step for selecting a truncation includes analyzing the domains and motifs structure(s) and function(s) of a class of enzymes, or proteins, or polypeptides. In some embodiments, the enzymes, or proteins, or polypeptides are non-LTR retrotransposons, reverse transcriptases, R2 reverse transcriptase, LTR retrotransposons, R2 non-LTR retrotransposons, or any combination thereof. In some embodiments, the enzymes, or proteins, or polypeptides are from different organisms. In some embodiments, all the domains of the enzymes, or proteins, or polypeptides are present. In some embodiments, all the domains are present to ensure reverse transcriptase activity. In some embodiments, all the domains are present to ensure the unique properties essential for the present disclosure. In some embodiments, the domains responsible for reverse transcriptase activity are not modified. In some embodiments, the R2 domain does not comprise modifications. In some embodiments, the R2 domain may comprise modifications. In some embodiments, the truncated variants show expression level. In some embodiments, the truncated variants that show promising expression level are further subject to small adjustment(s) in the sequence (step two). In some embodiments, the small adjustment(s) in the sequence include deletion, insertion, and/or substitution of amino acid(s). In some embodiments, the deletion, insertion, and/or substitution of amino acid(s) may include one or several amino acid(s). In some embodiments, the deletion, insertion, and/or substitution of amino acid(s) further optimize expression and/or stability (e.g., thermostability).

In some embodiments, the modified enzyme (e.g., modified reverse transcriptase), modified reverse transcriptase, or modified polypeptides has an N-terminal truncation, a C-terminal truncation, or both, relative to the wild type or unmodified enzyme (e.g., wild-type reverse transcriptase) or wild-type or unmodified polypeptide. In some embodiments, the polymerase comprises an N-terminal truncation, a C-terminal truncation, or both. In some embodiments, the modified reverse transcriptase comprises N-terminal truncation, C-terminal truncation, or a combination of N-terminal and C-terminal truncation(s). In some embodiments, the modified enzyme comprises N-terminal truncation, C-terminal truncation, or a combination of N-terminal and C-terminal truncation(s). In some embodiments, the modified polypeptide comprises N-terminal truncation, C-terminal truncation, or a combination of N-terminal and C-terminal truncation(s). In some embodiments, the truncation comprises the sequence MAHHHHHHVGTVGTGGGSG-GASTAL. In some embodiments, the modified reverse transcriptase, modified enzyme, modified polypeptide, modified non-LTR retrotransposon, or modified R2 reverse transcriptase comprises a truncation of less than about 100 amino acid residues. In some embodiments, the modified reverse transcriptase, modified enzyme, modified polypeptide, modified non-LTR retrotransposon, or modified R2 reverse transcriptase comprises at least one of: (a) an amino-terminal truncation of less than about 400 amino acid residues and (b) a carboxyl-terminal truncation of less than about 400 amino acid residues. In some embodiments, the modified reverse transcriptase, modified enzyme, modified polypeptide, modified non-LTR retrotransposon, or modified R2 reverse transcriptase lacks up to: about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 30, about 50, about 75, about 100, about 120, about 150, about 175, about 200, about 220, about 250, about 275, about 280, about 290, about 300, about 325, about 350, about 375, about 380, about 390, about 400, or about 450 amino acids from the N-terminus C-terminus, or both. In some embodiments, the modified reverse transcriptase, modified enzyme, modified polypeptide, modified non-LTR retrotransposon, or modified R2 reverse transcriptase may alternately or additionally have one or more internal deletions of up to: about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 amino acids, about 30, about 50, about 75, about 100, about 120, about 150, about 175, about 200, about 220, about 250, about 275, about 280, about 290, about 300, about 325, about 350, about 375, about 380, about 390, or a total of about 450 amino acids. In some embodiments, the N-terminal truncation, C-terminal truncation, or both, may comprise deletions from about 1 to about 50 amino acids, from about 1 to about 25, from about 1 to about 70, from about 10 to about 50, from about 20 to about 30, from about 15 to about 100, from about 1 to about 150, from about 15 to about 60, from about 15 to about 40, from about 1 to about 10, from about 10 to 35, from about 50 to about 100, from about 20 to about 150, from about 200 to about 350, from about 25 to about 350, from about 150 to about 400, from about 50 to about 400, from about 50 to about 450, from about 200 to about 400, or from about 50 to about 350, or from about 50 to about 400 amino acids. In some embodiments, the N-terminal truncation removes at least about 5, at least about 10, at least about 15, at least about 20, at least about 25, at least about 30, at least about 35, at least about 40, at least about 50, at least about 60, at least about 65, at least about 70, at least about 75, at least about 80, at least about 90, at least about 95, at least about 100, at least about 120, at least about 130, at least about 140, at least about 150, at least about 175, at least about 200, at least about 220, at least about 250, at least about 275, at least about 300, at least about 325, at least about 350, at least about 375, or at least about 400 amino acids. In some embodiments, the C-terminal truncation removes at least about 5, at least about 10, at least about 15, at least about 20, at least about 25, at least about 30, at least about 35, at least about 40, at least about 50, at least about 60, at least about 65, at least about 70, at least about 75, at least about 80, at least about 90, at least about 95, at least about 100, at least about 120, at least about 130, at least about 140, at least about 150, at least about 175, at least about 200, at least about 220, at least about 250, at least about 275, at least about 300, at least about 325, at least about 350, at least about 375, or at least about 400 amino acids. In some embodiments, the N-terminal truncation lacks about 5, about 10, about 15, about 20, about 25, about 30, about 35, about 40, about 50, about 60, about 65, about 70, about 75, about 80, about 90, about 95, about 100, about 120, about 130, about 140, about 150, about 175, about 200, about 220, about 250, about 275, about 300, about 325, about 350, about 375, or about 400 amino acids. In some embodiments, the C-terminal truncation lacks about 5, about 10, about 15, about 20, about 25, about 30, about 35, about 40, about 50, about 60, about 65, about 70, about 75, about 80, about 90, about 95, about 100, about 120, about 130, about 140, about 150, about 175, about 200, about 220, about 250, about 275, about 300, about 325, about 350, about 375, or about 400 amino acids. In some embodiments, the N-terminal truncation lacks no more than about 5, no more than about 10, no more than about 15, no more than about 20, no more than about 25, no more than about 30, no more than about 35, no more than about 40, no more than about 50, no more than about 60, no more than about 65, no more than about 70, no more than about 75, no more than about 80, no more than about 90, no more than about 95, no more than about 100, no more than about 120, no more than about 130, no more than about 140, no more than about 150, no more than about 175, no more than about 200, no more than about 220, no more than about 250, no more than about 275, no more than about 300, no more than about 325, no more than about 350, no more than about 375, or no more than about 400 amino acids. In some embodiments, the C-terminal truncation lacks no more than about 5, no more than about 10, no more than about 15, no more than about 20, no more than about 25, no more than about 30, no more than about 35, no more than about 40, no more than about 50, no more than about 60, no more than about 65, no more than about 70, no more than about 75, no more than about 80, no more than about 90, no more than about 95, no more than about 100, no more than about 120, no more than about 130, no more than about 140, no more than about 150, no more than about 175, no more than about 200, no more than about 220, no more than about 250, no more than about 275, no more than about 300, no more than about 325, no more than about 350, no more than about 375, or no more than about 400 amino acids. In some embodiments, the truncation comprises an N-terminal truncation that removes at least about, at most about, or about 5, 10, 15, 20, 25, 30, 40, 50, 75, 100, 125, 150, 175, 200, 225, 250, 275, 300, 325, 350, 375, 400, 425, 450, 475, or 500 amino acids. In some embodiments, the truncation comprises a C-terminal truncation that removes at least about, at most about, or about 5, 10, 15, 20, 25, 30, 40, 50, 75, 100, 125, 150, 175, 200, 225, 250, 275, 300, 325, 350, 375, 400, 425, 450, 475, or 500 amino acids. In some embodiments, the N-terminal truncation, the C-terminal truncation, or both, may be more than about 500 amino acids, more than about 1000 amino acids, more than about 1500 amino acids, more than about 2000 amino acids, more than about 5000 amino acids, more than about 10000 amino acids, more than about 100000 amino acids, more than about 1000000 amino acids.

In some embodiments, truncations of regions which do affect functional activity of a protein or enzyme may be engineered. In some embodiments, truncations of regions which do not affect functional activity of a protein or enzyme may be engineered. A truncation may comprise a truncation of less than about 5, less than about 10, less than about 15, less than about 20, less than about 25, less than about 30, less than about 35, less than about 40, less than about 45, less than about 50, less than about 60, less than about 70, less than about 80, less than about 90, less than about 100, less than about 125, less than about 150, less than about 200, less than about 250, less than about 300, less than about 350, less than about 400 or more amino acids. A truncation may comprise a truncation of more than about 5, more than about 10, more than about 15, more than about 20, more than about 25, more than about 30, more than about 35, more than about 40, more than about 45, more than about 50, more than about 60, more than about 70, more than about 80, more than about 90, more than about 100, more than about 125, more than about 150, more than about 200, more than about 250, more than about 300, more than about 350, more than about 400 or more amino acids. A truncation may comprise a truncation of about 5%, about 10%, about 15%, about 20%, about 25%, about 30%, about 35%, about 40%, about 45%, about 50%, about 55%, about 60%, about 65%, about 70%, about 75%, about 80%, about 85%, about 87%, about 90%, about 92%, about 95% or about 100% of the polypeptide or enzyme.

In some embodiments, the variant or modified enzyme or modified protein may comprise one or more modification(s) at an amino acid position. In some embodiments, a variant, a mutant, or modified polypeptides or enzymes of the present disclosure may possess an increased activity, such as an increased RNA-dependent DNA polymerase activity or a DNA-dependent DNA polymerase activity, compared to the corresponding unmutated or unmodified or wildtype polymerase or as compared to one or more polymerases (e.g., RNA-dependent DNA polymerase, or a reverse transcriptase). In some embodiments, a polymerase or a reverse transcriptase having an increase in activity may be a modified polymerase or a modified reverse transcriptase that has at least about a 5% increase, at least about a 10% increase, at least about a 25% increase, at least about a 30% increase, at least about a 50% increase, at least about a 100% increase, at least about a 150% increase, at least about a 200% increase, at least about a 3001% increase, at least about a 500% increase, at least about a 1,000% increase, at least about a 2,500% increase or at least about a 5,000% increase as compared to (1) the corresponding unmutated or wild-type enzyme; or (2) a particular polymerase (e.g., RNA-dependent DNA polymerase, reverse transcriptase) or a particular reverse transcriptase, or a group of polymerases, or a group of reverse transcriptases. In some embodiments, the modified polymerase or the modified reverse transcriptase of the present disclosure may have an increase in activity of from about 5% to about 5,000%, from about 5% to about 2,500%, from about 5% to about 1000%, from about 5% to about 500%, from about 5% to about 250%, from about 5% to about 100%, from about 5% to about 50%, from about 5% to about 25%, from about 25% to about 5,000%, from about 25% to about 2,500%, from about 25% to about 1,000%, from about 25% to about 500%, from about 25% to about 250%, from about 25% to about 100%, from about 100% to about 5,000%, from about 100% to about 2,500%, from about 100% to about 1000%, from about 100% to about 500%, or from about 100% to about 250%. An increase in RNA-dependent DNA polymerase activity and/or DNA-dependent DNA polymerase for a modified polymerase or modified reverse transcriptase of the present disclosure may also be measured according to relative activity compared to (1) the corresponding unmodified or wild-type enzyme; or (2) a particular polymerase (e.g., RNA-dependent DNA polymerase, reverse transcriptase) or a particular reverse transcriptase, or a group of polymerases, or a group of reverse transcriptases. In some embodiments, the increase in such relative activity is at least about 1.1, 1.2, 1.5, 2, 5, 10, 25, 50, 75, 100, 150, 200, 300, 500, 1,000, 2,500, 5,000, 10,000, or 25,000 fold when the activity of a modified polymerase or modified reverse transcriptase of the present disclosure is compared to (1) the corresponding unmutated or wild-type enzyme; or (2) a particular polymerase (e.g., RNA-dependent DNA polymerase, reverse transcriptase) or a particular reverse transcriptase, or a group of polymerases, or a group of reverse transcriptases. Thus a modified polymerase or modified reverse transcriptase of the present disclosure may have an increased RNA-dependent DNA polymerase and/or an increased DNA-dependent DNA polymerase activity of from about 1.1 fold to about 25,000 fold, from about 1.1 fold to about 10,000 fold, from about 1.1 fold to about 5,000 fold, from about 1.1 fold to about 2,500 fold, from about 1.1 fold to about 1,000 fold, from about 1.1 fold to about 500 fold, from about 1.1 fold to about 250 fold, from about 1.1 fold to about 50 fold, from about 1.1 fold to about 25 fold, from about 1.1 fold to about 10 fold, from about 1.1 fold to about 5 fold, from about 5 fold to about 25,000 fold, from about 5 fold to about 5,000 fold, from about 5 fold to about 1,000 fold, from about 5 fold to about 500 fold, from about 5 fold to about 100 fold, from about 5 fold to about 50 fold, from about 5 fold to about 25 fold, from about 50 fold to about 25,000 fold, from about 50 fold to about 5,000 fold, from about 50 fold to about 1,000 fold, from about 50 fold to about 500 fold, from about 50 fold to about 100 fold, from about 100 fold to about 25,000 fold, from about 1,000 fold to about 25,000 fold, from about 4,000 fold to about 25,000 fold, from about 10,000 fold to about 25,000 fold, from about 15,000 fold to about 25,000 fold, from about 1,000 fold to about 10,000 fold, from about 2,500 fold, to about 10,000 fold, from about 5,000 fold to about 10,000 fold, from about 7,500 fold to about 10,000 fold, from about 1,000 fold to about 15,000 fold, from about 2,500 fold, to about 15,000 fold, from about 5,000 fold to about 15,000 fold, from about 7,500 fold to about 15,000 fold, from about 10,000 fold to about 15,000 fold, or from about 12,500 fold to about 15,000 fold.

In some embodiments, a modified enzyme, modified polypeptide having reverse transcriptase activity, or a non-naturally occurring enzyme exhibits an altered (e.g., increased or decreased) processivity for a given nucleotide substrate relative to an unmodified or naturally occurring counterpart. In some embodiments, the modified enzyme, modified polypeptide having reverse transcriptase activity, or a non-naturally occurring enzyme exhibits a processivity for a given nucleotide substrate that is at least about 5%, 10%, 25%, 37.5%, 50%, 75%, 100%, 110%, 125%, 150%, 200%, 250%, 500%, 750%, 1,000%, 5,000% or 10,000% as high as the processivity of a reference enzyme for the same nucleotide substrate. In some embodiments, the reference enzyme is the unmodified counterpart of the modified enzyme. In some embodiments, the reference enzyme is a reverse transcriptase. In some embodiments, the reference enzyme is a non-LTR retrotransposon. In some embodiments, the reference enzyme is a LTR retrotransposon. In some embodiments, the reference enzyme is an R2 reverse transcriptase. In some embodiments, the reference enzyme or polypeptide comprises an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8. SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16. SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, and/or SEQ ID NO: 48. In some embodiments, an R2 comprises at least one mutation and/or modification. In some embodiments, an R2 comprises an amino acid sequence of SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, or SEQ ID NO: 67. In some embodiments, an R2 and/or a modified enzyme and/or a modified reverse transcriptase comprises a mutation at one or more amino acids selected from (but not limited to) C952S, and/or C956S, and/or C952S, C956S (double mutant), and/or C969S, and/or H970Y, and/or R979Q, and/or R976Q, and/or R1071S, and/or R328A, and/or R329A, and/or Q336A, and/or R328A, R329A, Q336A (triple mutant), and/or G426A, and/or D428A, and/or G426A, D428A (double mutant), and/or any combination thereof. In some embodiments, the amino acid position is based on SEQ ID NO: 52. In some embodiments, the amino acid position is based on a wild-type reverse transcriptase. In some embodiments, the amino acid position is based on a wild-type R2. In some embodiments, a cysteine is mutated. In some embodiments, a cysteine is mutated to a serine. In some embodiments, an arginine is mutated. In some embodiments, an arginine is mutated to a serine, or a glutamine, or an alanine. In some embodiments, an amino acid is mutated to an alanine. In some embodiments, a glutamine is mutated to an alanine. In some embodiments, an aspartic acid is mutated to an alanine. In some embodiments, a glycine is mutated to an alanine. In some embodiments, a histidine is mutated to a tyrosine.

In some embodiments, a variant, or a modified enzyme (e.g., modified reverse transcriptase), or a modified polypeptide having reverse transcriptase activity of the present disclosure comprises at least one altered characteristic that improves enzyme property. In some embodiments, a variant or a modified enzyme (e.g., modified reverse transcriptase) or a modified polypeptide having reverse transcriptase activity of the present disclosure comprises at least about 35%, at least about 40%, at least about 45%, at least about 50%, at least about 55%, at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, and at least about 99% sequence identity to an amino acid sequence disclosed in the present disclosure. In some embodiments, a variant, or a modified enzyme, or a modified polypeptide having reverse transcriptase activity comprises at least about 35%, at least about 40%, at least about 45%, at least about 50%, at least about 55%, at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, and/or at least about 99% sequence identity to an amino acid sequence corresponding to a GenBank number in TABLE 1. In some embodiments, a variant, or a modified enzyme, or a modified polypeptide having reverse transcriptase activity comprises at least about 35%, at least about 40%, at least about 45%, at least about 50%, at least about 55%, at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, and/or at least about 99%, sequence identity to an amino acid sequence set forth in SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8. SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, and/or SEQ ID NO: 48. In some embodiments, a variant, or a modified enzyme, or a modified polypeptide having reverse transcriptase activity comprises at least about 35%, at least about 40%, at least about 45%, at least about 50%, at least about 55%, at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, and/or at least about 99% sequence identity to an amino acid sequence set forth in SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, and/or SEQ ID NO: 67. See TABLE 2. SEQ ID NO: 49 is an example of an R2 RT C-truncation, SEQ ID NO: 50 is an example of an R2 RT N-truncation, SEQ ID NO: 51 is an example of an R2 RT N- and C-truncation, SEQ ID NO: 52 is an example of an R2 wild type. SEQ ID NO: 53-67 are examples of R2 with single, double, or triple mutations (TABLE 2). In some embodiments, the modified reverse transcriptase is derived from an arthropod. In some embodiments, the arthropod is *Bombyx mori*.

TABLE 1

| GenBank | Description | GI number | SEQ ID NO: |
|---|---|---|---|
| AAB59214.1 | reverse transcriptase-like protein [*Bombyx mori*] | 903695 | 1 |
| T18197 | reverse transcriptase-like protein - silkworm | 7511784 | 2 |
| KMQ90176.1 | reverse transcriptase [*Lasius niger*] | 861630869 | 3 |
| KYB24671.1 | Retrovirus-related Pol polyprotein from type-2 retrotransposable element R2DM-like Protein [*Tribolium castaneum*] | 1004394526 | 4 |
| KMQ90064.1 | reverse transcriptase [*Lasius niger*] | 861630480 | 5 |
| ACJ71597.1 | reverse transcriptase [*Rhynchosciara americana*] | 215982090 | 6 |
| AFM44926.1 | R2 protein [*Eyprepocnemis plorans*] | 391862173 | 7 |
| AHN53448.1 | reverse transcriptase [*Nuttalliella namaqua*] | 599127491 | 8 |
| ACJ46647.1 | reverse transcriptase [*Triops cancriformis*] | 213399743 | 9 |
| BAC82590.1 | reverse transcriptase [*Ciona intestinalis*] | 34392525 | 10 |
| AAB94032.1 | reverse transcriptase domain protein [*Drosophila mercatorum*] | 2735957 | 11 |
| AAC34906.1 | reverse transcriptase [*Forficula auricularia*] | 3559776 | 12 |
| BAC82589.1 | reverse transcriptase [*Ciona intestinalis*] | 34392523 | 13 |
| AIL01110.1 | reverse transcriptase [*Bacillus rossius*] | 674275091 | 14 |
| AFO19998.1 | R2 protein [*Lepidurus couesii*] | 397174834 | 15 |
| KMQ88340.1 | reverse transcriptase [*Lasius niger*] | 861624704 | 16 |
| AFO19997.1 | R2 protein [*Lepidurus couesii*] | 397174832 | 17 |
| AAC34903.1 | reverse transcriptase [*Anurida maritima*] | 3559770 | 18 |
| AFO19995.1 | R2 protein [*Lepidurus apus lubbocki*] | 397174828 | 19 |
| BAC82591.1 | reverse transcriptase [*Ciona intestinalis*] | 34392527 | 20 |
| CAX83712.1 | endonuclease-reverse transcriptase [*Schistosoma japonicum*] | 254587310 | 21 |
| XP_009165216.1 | hypothetical protein T265_13057 [*Opisthorchis viverrini*] | 684375893 | 22 |
| AAB94040.1 | reverse transcriptase [*Hippodamia convergens*] | 2736050 | 23 |
| AAV85443.1 | reverse transcriptase-like protein [*Amblyomma americanum*] | 56267941 | 24 |
| AAV85445.1 | reverse transcriptase-like protein [*Ixodes scapularis*] | 56267945 | 25 |
| KRY44798.1 | Retrovirus-related Pol polyprotein from type-2 retrotransposable element R2DM [*Trichinella britovi*] | 954380717 | 26 |
| AAV85444.1 | reverse transcriptase-like protein [*Rhipicephalus microplus*] | 56267943 | 27 |

TABLE 1-continued

| GenBank | Description | GI number | SEQ ID NO: |
|---|---|---|---|
| KRX52183.1 | Retrovirus-related Pol polyprotein from type-2 retrotransposable element R2DM [*Trichinella* sp. T9] | 954258524 | 28 |
| KRX72028.1 | Retrovirus-related Pol polyprotein from type-2 retrotransposable element R2DM [*Trichinella* sp. T6] | 954280597 | 29 |
| AFO19999.1 | R2 protein [*Lepidurus couesii*] | 397174836 | 30 |
| AAA21258.1 | reverse transcriptase [*Drosophila ambigua*] | 533135 | 31 |
| KRX12851.1 | Retrovirus-related Pol polyprotein from type-2 retrotransposable element R2DM [*Trichinella nelsoni*] | 954202918 | 32 |
| KFD59471.1 | hypothetical protein M514_11684 [*Trichuris suis*] | 669318869 | 33 |
| KXZ75771.1 | hypothetical protein TcasGA2_TC031700 [*Tribolium castaneum*] | 1004173031 | 34 |
| XP_002412745.1 | reverse transcriptase, putative [*Ixodes scapularis*] | 241683764 | 35 |
| BAE46603.1 | reverse transcriptase [*Eptatretus burgeri*] | 77799487 | 36 |
| AF020000.1 | R2 protein [*Triops cancriformis*] | 397174838 | 37 |
| KRX36111.1 | Retrovirus-related Pol polyprotein from type-2 retrotransposable element R2DM [*Trichinella murrelli*] | 954240338 | 38 |
| KRZ66264.1 | Retrovirus-related Pol polyprotein from type-2 retrotransposable element R2DM [*Trichinella papuae*] | 954588567 | 39 |
| KRY45664.1 | Retrovirus-related Pol polyprotein from type-2 retrotransposable element R2DM [*Trichinella britovi*] | 954382014 | 40 |
| CAJ00246.1 | TPA: polyprotein [*Schistosoma mansoni*] | 67625717 | 41 |
| Q03278 | Retrovirus-related Pol polyprotein from type-1 retrotransposable element R2 [*Nasonia vitripennis* (Parasitic wasp)] | 2851550 | 42 |
| Q03279 | Retrovirus-related Pol polyprotein from type-1 retrotransposable element R2 [*Bradysia coprophila* (Dark-winged fungus gnat) (*Sciara coprophila*)] | 548546 | 43 |
| KXZ75830.1 | hypothetical protein TcasGA2_TC031908 [*Tribolium castaneum*] | 1004173289 | 44 |
| P16423.1 | RecName: Full = Retrovirus-related Pol polyprotein from type-2 retrotransposable element R2DM [*Drosophila melanogaster*] | 130551 | 45 |
| KRX34481.1 | Retrovirus-related Pol polyprotein from type-2 retrotransposable element R2DM [*Trichinella murrelli*] | 954238165 | 46 |
| EEB15300.1 | [*Pediculus humanus corporis*] - reverse transcriptase, putative | 212512557 | 47 |
| XP_002431867.1 | reverse transcriptase, putative [*Pediculus humanus corporis*] | | 48 |

TABLE 2

| Description | Sequence | SEQ ID NO: |
|---|---|---|
| Example of a C-terminal truncation | MAHHHHHHVGTVGTGGGSGGASTALSLMGRCNPD GCTRGKHVTAAPMDGPRGPSSLAGTFGWGLAIPAG EPCGRVCSPATVGFFPVAKKSNKENRPEASGLPLESE RTGDNPTVRGSAGADPVGQDAPGWTCQFCERTFS TNRGLGVHKRRAHPVETNTDAAPMMVKRRWHGE EIDLLARTEARLLAERGQCSGGDLFGALPGFGRTLEAI KGQRRREPYRALVQAHLARFGSQPGPSSGGCSAEP DFRRASGAEEAGEERCAEDAAAYDPSAVGQMSPDA ARVLSELLEGAGRRRACRAMRPKTAGRRNDLHDDRT ASAHKTSRQKRRAEYARVQELYKKCRSRAAAEVIDGA CGGVGHSLEEMETYWRPILERVSDAPGPTPEALHALG RAEWHGGNRDYTQLWKPISVEEIKASRFDWRTSPGP DGIRSGQWRAVPVHLKAEMFNAWMARGEIPEILRQ CRTVFVPKVERPGGPGEYRPISIASIPLRHFHSILARRLL ACCPPDARQRGFICADGTLENSAVLDAVLGDSRKKLR ECHVAVLDFAKAFDTVSHEALVELLRLRGMPEQFCGY IAHLYDTASTTLAVNNEMSSPVKVGRGVRQGDPLSPIL FNVVMDLILASLPERVGYRLEMELVSALAYADDLVLLA GSKVGMQESISAVDCVGRQMGLRLNCRKSAVLSMIP DGHRKKHHYLTERTFNIGGKPLRQVSCVERWRYLGVD FEASGCVTLEHSISSALNNISRAPLKPQQRLEILRAHLIPR | 49 |

TABLE 2-continued

| Description | Sequence | SEQ ID NO: |
|---|---|---|
| | FQHGFVLGNISDDRLRMLDVQIRKAVGQWLRLPADVP<br>KAYYHAAVQDGGLAIPSVRATIPDLIVRRFGGLDSSPWS<br>VARAAAKSDKIRKKLRWAWKQLRRFSRVDSTTQRPSVRL<br>FWREHLASVDGRELRESTRTPTSTKWIRERCAQGGGVG | |
| Example of N-terminal truncation | MAHHHHHHVGTVGTGGGSGGASTALKTAGRRNDL<br>HDDRTASAHKTSRQKRRAEYARVQELYKKCRSAAA<br>EVIDGACGGVGHSLEEMETYWRPILERVSDAPGPTP<br>EALHALGRAEWHGGNRDYTQLWKPISVEEIKASRFD<br>WRTSPGPDGIRSGQWRAVPVHLKAEMFNAWMAR<br>GEIPEILRQCRTVFVPKVERPGGPGEYRPISIASIPLRH<br>FHSILARRLLACCPPDARQRGFICADGTLENSAVLDAV<br>LGDSRKKLRECHVAVLDFAKAFDTVSHEALVELLRLRG<br>MPEQFCGYIAHLYDTASTTLAVNNEMSSPVKVGRGV<br>RQGDPLSPILFNVVMDLILASLPERVGYRLEMELVSAL<br>AYADDLVLLAGSKVGMQESISAVDCVGRQMGLRLNC<br>RKSAVLSMIPDGHRKKHHYLTERTFNIGGKPLRQVSC<br>VERWRYLGVDFEASGCVTLEHSISSALNNISRAPLKPQ<br>QRLEILRAHLIPRFQHGFVLGNISDDRLRMLDVQIRKA<br>VGQWLRLPADVPKAYYHAAVQDGGLAIPSVRATIPDL<br>IVRRFGGLDSSPWSVARAAAKSDKIRKKLRWAWKQLR<br>RFSRVDSTTQRPSVRLFWREHLASVDGRELRESTRTP<br>TSTKWIRERCAQITGRDFVQFVHTHINALPSRIRGSRGR<br>RGGGESSLTCRAGCKVRETTAHILQQCHRTHGGRILRH<br>NKIVSFVAKAMEENKWTVELEPRLRTSVGLRKPDIIASRD<br>GVGVIVDVQVVSGQRSLDELHREKRNKYGNHGELVELV<br>AGRLGLPKAECVRATSCTISWRGVWSLTSYKELRSIIGLRE<br>PTLQIVPILALRGSHMNWTRFNQMTSVMGGGVG | 50 |
| Example of N-, C-truncation | MAHHHHHHVGTVGTGGGSGGASTALKTAGRRNDL<br>HDDRTASAHKTSRQKRRAEYARVQELYKKCRSAAA<br>EVIDGACGGVGHSLEEMETYWRPILERVSDAPGPTP<br>EALHALGRAEWHGGNRDYTQLWKPISVEEIKASRFD<br>WRTSPGPDGIRSGQWRAVPVHLKAEMFNAWMAR<br>GEIPEILRQCRTVFVPKVERPGGPGEYRPISIASIPLRH<br>FHSILARRLLACCPPDARQRGFICADGTLENSAVLDAV<br>LGDSRKKLRECHVAVLDFAKAFDTVSHEALVELLRLRG<br>MPEQFCGYIAHLYDTASTTLAVNNEMSSPVKVGRGV<br>RQGDPLSPILFNVVMDLILASLPERVGYRLEMELVSAL<br>AYADDLVLLAGSKVGMQESISAVDCVGRQMGLRLNC<br>RKSAVLSMIPDGHRKKHHYLTERTFNIGGKPLRQVSC<br>VERWRYLGVDFEASGCVTLEHSISSALNNISRAPLKPQ<br>QRLEILRAHLIPRFQHGFVLGNISDDRLRMLDVQIRKA<br>VGQWLRLPADVPKAYYHAAVQDGGLAIPSVRATIPDL<br>IVRRFGGLDSSPWSVARAAAKSDKIRKKLRWAWKQL<br>RRFSRVDSTTQRPSVRLFWREHLASVDGRELRESTR<br>TPTSTKWIRERCAQGGGVG | 51 |
| R2 wild type | MAHHHHHHVGTVGTGGGSGGASTALSLMGRCNPD<br>GCTRGKHVTAAPMDGPRGPSSLAGTFGWGLAIPAGE<br>PCGRVCSPATVGFFPVAKKSNKENRPEASGLPLESERT<br>GDNPTVRGSAGADPVGQDAPGWTCQFCERTFSTNR<br>GLGVHKRRAHPVETNTDAAPMMVKRRWHGEEIDLL<br>ARTEARLLAERGQCSGGDLFGALPGFGRTLEAIKGQRR<br>REPYRALVQAHLARFGSQPGPSSGGCSAEPDFRRASG<br>AEEAGEERCAEDAAAYDPSAVGQMSPDAARVLSELLE<br>GAGRRRACRAMRPKTAGRRNDLHDDRTASAHKTSRQ<br>KRRAEYARVQELYKKCRSRAAAEVIDGACGGVGHSLEE<br>METYWRPILERVSDAPGPTPEALHALGRAEWHGGNR<br>DYTQLWKPISVEEIKASRFDWRTSPGPDGIRSGQWRA<br>VPVHLKAEMFNAWMARGEIPEILRQCRTVFVPKVERP<br>GGPGEYRPISIASIPLRHFHSILARRLLACCPPDARQRGF<br>ICADGTLENSAVLDAVLGDSRKKLRECHVAVLDFAKAFD<br>TVSHEALVELLRLRGMPEQFCGYIAHLYDTASTTLAVNN<br>EMSSPVKVGRGVRQGDPLSPILFNVVMDLILASLPERV<br>GYRLEMELVSALAYADDLVLLAGSKVGMQESISAVDCV<br>GRQMGLRLNCRKSAVLSMIPDGHRKKHHYLTERTFNIG<br>GKPLRQVSCVERWRYLGVDFEASGCVTLEHSISSALNNIS<br>RAPLKPQQRLEILRAHLIPRFQHGFVLGNISDDRLRMLD<br>VQIRKAVGQWLRLPADVPKAYYHAAVQDGGLAIPSVRA<br>TIPDLIVRRFGGLDSSPWSVARAAAKSDKIRKKLRWAWK<br>QLRRFSRVDSTTQRPSVRLFWREHLASVDGRELRESTRT<br>PTSTKWIRERCAQITGRDFVQFVHTHINALPSRIRGSRGR<br>RGGGESSLTCRAGCKVRETTAHILQQCHRTHGGRILRHNK<br>IVSFVAKAMEENKWTVELEPRLRTSVGLRKPDIIASRDGVG | 52 |

TABLE 2-continued

| Description | Sequence | SEQ ID NO: |
|---|---|---|
| | VIVDVQVVSGQRSLDELHREKRNKYGNHGELVELVAGRLG<br>LPKAECVRATSCTISWRGVWSLTSYKELRSIIGLREPTLQIVP<br>ILALRGSHMNWTRFNQMTSVMGGGVG | |
| C952S | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTSRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 53 |
| C956S | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGSKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 54 |
| C952S, C956S | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS | 55 |

TABLE 2-continued

| Description | Sequence | SEQ ID NO: |
|---|---|---|
| | AVLDAVLGDSRKKLRECHVAVLDFAKAFDTVSHEAL VELLRLRGMPEQFCGYIAHLYDTASTTLAVNNEMSSPVKVG RGVRQGDPLSPILFNVVMDLILASLPERVGYRLEMELVS ALAYADDLVLLAGSKVGMQESISAVDCVGRQMGLRLNCRK SAVLSMIPDGHRKKHHYLTERTFNIGGKPLRQVSCVERWR YLGVDFEASGCVTLEHSISSALNNISRAPLKPQQRLEILRAHL IPRFQHGFVLGNISDDRLRMLDVQIRKAVGQWLRLPA DVPKAYYHAAVQDGGLAIPSVRATIPDLIVRRFGGLDSSPWS VARAAAKSDKIRKKLRWAWKQLRRFSRVDSTTQRPSVR LFWREHLHASVDGRELRESTRTPTSTKWIRERCAQITGRDFV QFVHTHINALPSRIRGSRGRRGGGESSLTSRAGSKVRE TTAHILQQCHRTHGGRILRHNKIVSFVAKAMEENKWTVELE PRLRTSVGLRKPDIIASRDGVGVIVDVQVVSGQRSLDEL HREKRNKYGNHGELVELVAGRLGLPKAECVRATSCTISWR GVWSLTSYKELRSIIGLREPTLQIVPILALRGSHMNWTRF NQMTSVMGGGVG* | |
| C969S | MAHHHHHHVGTVGTGGGSGGASTALSLMGRCNPDGCTRG KHVTAAPMDGPRGPSSLAGTFGWGLAIPAGEPCGRVCSPAT VGFFPVAKKSNKENRPEASGLPLESERTGDNPTVRGSAGAD PVGQDAPGWTCQFCERTFSTNRGLGVHKRRAHPVETNTD AAPMMVKRRWHGEEIDLLARTEARLLAERGQCSGGDLFGA LPGFGRTLEAIKGQRREPYRALVQAHLARFGSQPGPSSG GCSAEPDFRRASGAEEAGEERCAEDAAAYDPSAVGQMSPD AARVLSELLEGAGRRRACRAMRPKTAGRRNDLHDDRTASA HKTSRQKRRAEYARVQELYKKCRSRAAAEVIDGACGGVGH SLEEMETYWRPILERVSDAPGPTPEALHALGRAEWHGGNR DYTQLWKPISVEEIKASRFDWRTSPGPDGIRSGQWRAVPVH LKAEMFNAWMARGEIPEILRQCRTVFVPKVERPGGPGEY RPISIASIPLRHFHSILARRLLACCPPDARQRGFICADGTLENS AVLDAVLGDSRKKLRECHVAVLDFAKAFDTVSHEAL VELLRLRGMPEQFCGYIAHLYDTASTTLAVNNEMSSPVKVG RGVRQGDPLSPILFNVVMDLILASLPERVGYRLEMELVS ALAYADDLVLLAGSKVGMQESISAVDCVGRQMGLRLNCRK SAVLSMIPDGHRKKHHYLTERTFNIGGKPLRQVSCVERWR YLGVDFEASGCVTLEHSISSALNNISRAPLKPQQRLEILRAHL IPRFQHGFVLGNISDDRLRMLDVQIRKAVGQWLRLPA DVPKAYYHAAVQDGGLAIPSVRATIPDLIVRRFGGLDSSPWS VARAAAKSDKIRKKLRWAWKQLRRFSRVDSTTQRPSVR LFWREHLHASVDGRELRESTRTPTSTKWIRERCAQITGRDFV QFVHTHINALPSRIRGSRGRRGGGESSLTCRAGCKVRE TTAHILQQSHRTHGGRILRHNKIVSFVAKAMEENKWTVELE PRLRTSVGLRKPDIIASRDGVGVIVDVQVVSGQRSLDEL HREKRNKYGNHGELVELVAGRLGLPKAECVRATSCTISWR GVWSLTSYKELRSIIGLREPTLQIVPILALRGSHMNWTRF NQMTSVMGGGVG* | 56 |
| H970Y | MAHHHHHHVGTVGTGGGSGGASTALSLMGRCNPDGCTRG KHVTAAPMDGPRGPSSLAGTFGWGLAIPAGEPCGRVCSPAT VGFFPVAKKSNKENRPEASGLPLESERTGDNPTVRGSAGAD PVGQDAPGWTCQFCERTFSTNRGLGVHKRRAHPVETNTD AAPMMVKRRWHGEEIDLLARTEARLLAERGQCSGGDLFGA LPGFGRTLEAIKGQRREPYRALVQAHLARFGSQPGPSSG GCSAEPDFRRASGAEEAGEERCAEDAAAYDPSAVGQMSPD AARVLSELLEGAGRRRACRAMRPKTAGRRNDLHDDRTASA HKTSRQKRRAEYARVQELYKKCRSRAAAEVIDGACGGVGH SLEEMETYWRPILERVSDAPGPTPEALHALGRAEWHGGNR DYTQLWKPISVEEIKASRFDWRTSPGPDGIRSGQWRAVPVH LKAEMFNAWMARGEIPEILRQCRTVFVPKVERPGGPGEY RPISIASIPLRHFHSILARRLLACCPPDARQRGFICADGTLENS AVLDAVLGDSRKKLRECHVAVLDFAKAFDTVSHEAL VELLRLRGMPEQFCGYIAHLYDTASTTLAVNNEMSSPVKVG RGVRQGDPLSPILFNVVMDLILASLPERVGYRLEMELVS ALAYADDLVLLAGSKVGMQESISAVDCVGRQMGLRLNCRK SAVLSMIPDGHRKKHHYLTERTFNIGGKPLRQVSCVERWR YLGVDFEASGCVTLEHSISSALNNISRAPLKPQQRLEILRAHL IPRFQHGFVLGNISDDRLRMLDVQIRKAVGQWLRLPA DVPKAYYHAAVQDGGLAIPSVRATIPDLIVRRFGGLDSSPWS VARAAAKSDKIRKKLRWAWKQLRRFSRVDSTTQRPSVR LFWREHLHASVDGRELRESTRTPTSTKWIRERCAQITGRDFV QFVHTHINALPSRIRGSRGRRGGGESSLTCRAGCKVRE TTAHILQQCYRTHGGRILRHNKIVSFVAKAMEENKWTVELE PRLRTSVGLRKPDIIASRDGVGVIVDVQVVSGQRSLDEL HREKRNKYGNHGELVELVAGRLGLPKAECVRATSCTISWR GVWSLTSYKELRSIIGLREPTLQIVPILALRGSHMNWTRF NQMTSVMGGGVG* | 57 |

TABLE 2-continued

| Description | Sequence | SEQ ID NO: |
|---|---|---|
| R979Q | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILQHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 58 |
| R976Q | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGQILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 59 |
| R1071S | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK | 60 |

TABLE 2-continued

| Description | Sequence | SEQ ID NO: |
|---|---|---|
| | SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVSATSCTISWR<br>GVWSLTSYKELRSIIGLREPTLQIVPILALRGSHMNWTRF<br>NQMTSVMGGGVG* | |
| R328A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKARAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 61 |
| R329A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRAAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 62 |
| Q336A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD | 63 |

TABLE 2-continued

| Description | Sequence | SEQ ID NO: |
|---|---|---|
| | AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVAELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | |
| R328A, R329A, Q336A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKAAAEYARVAELYKKCRSRAAAEVIDGACGGVGH<br>SLEEMETYWRPILERVSDAPGPTPEALHALGRAEWHGGNR<br>DYTQLWKPISVEEIKASRFDWRTSPGPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 64 |
| G426A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPAPDGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS | 65 |

TABLE 2-continued

| Description | Sequence | SEQ ID NO: |
|---|---|---|
| | VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | |
| D428A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPGPAGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 66 |
| G426A, D428A | MAHHHHHHVGTVGTGGGSGGASTALSLMGRCNPDGCTRG<br>KHVTAAPMDGPRGPSSLAGTFGWGLAIPAGEPCGRVCSPAT<br>VGFFPVAKKSNKENRPEASGLPLESERTGDNPTVRGSAGAD<br>PVGQDAPGWTCQFCERTFSTNRGLGVHKRRAHPVETNTD<br>AAPMMVKRRWHGEEIDLLARTEARLLAERGQCSGGDLFGA<br>LPGFGRTLEAIKGQRRREPYRALVQAHLARFGSQPGPSSG<br>GCSAEPDFRRASGAEEAGEERCAEDAAAYDPSAVGQMSPD<br>AARVLSELLEGAGRRRACRAMRPKTAGRRNDLHDDRTASA<br>HKTSRQKRRAEYARVQELYKKCRSRAAAEVIDGACGGVGH<br>SLEEMETYWRPILERVSDAPGPTPEALHALGRAEWHGGNR<br>DYTQLWKPISVEEIKASRFDWRTSPAPAGIRSGQWRAVPVH<br>LKAEMFNAWMARGEIPEILRQCRTVFVPKVERPGGPGEY<br>RPISIASIPLRHFHSILARRLLACCPPDARQRGFICADGTLENS<br>AVLDAVLGDSRKKLRECHVAVLDFAKAFDTVSHEAL<br>VELLRLRGMPEQFCGYIAHLYDTASTTLAVNNEMSSPVKVG<br>RGVRQGDPLSPILFNVVMDLILASLPERVGYRLEMELVS<br>ALAYADDLVLLAGSKVGMQESISAVDCVGRQMGLRLNCRK<br>SAVLSMIPDGHRKKHHYLTERTFNIGGKPLRQVSCVERWR<br>YLGVDFEASGCVTLEHSISSALNNISRAPLKPQQRLEILRAHL<br>IPRFQHGFVLGNISDDRLRMLDVQIRKAVGQWLRLPA<br>DVPKAYYHAAVQDGGLAIPSVRATIPDLIVRRFGGLDSSPWS<br>VARAAAKSDKIRKKLRWAWKQLRRFSRVDSTTQRPSVR<br>LFWREHLHASVDGRELRESTRTPTSTKWIRERCAQITGRDFV<br>QFVHTHINALPSRIRGSRGRRGGGESSLTCRAGCKVRE<br>TTAHILQQCHRTHGGRILRHNKIVSFVAKAMEENKWTVELE<br>PRLRTSVGLRKPDIIASRDGVGVIVDVQVVSGQRSLDEL<br>HREKRNKYGNHGELVELVAGRLGLPKAECVRATSCTISWR<br>GVWSLTSYKELRSIIGLREPTLQIVPILALRGSHMNWTRF<br>NQMTSVMGGGVG* | 67 |

In some embodiments, the polypeptides, proteins, enzymes, modified enzymes (e.g., modified reverse transcriptase), modified polypeptides, non-naturally occurring enzymes, or variants comprise a fusion with, but not limited to, a protein, a domain, a fusion partner, a carrier protein, a target sequence, an antigenic determinant, or any combination thereof. In some embodiments, the reverse transcriptase or modified reverse transcriptase is fused to a protein, a domain, a fusion partner, a target sequence, an antigenic determinant, or any combination thereof. In some embodiments, the non-LTR retrotransposon or modified non-LTR retrotransposon is fused to a protein, a domain, a fusion partner, a target sequence, an antigenic determinant, or any combination thereof. In some embodiments, the modified LTR retrotransposon is fused to a protein, a domain, a fusion partner, a target sequence, an antigenic determinant, or any combination thereof. In some embodiments, the modified R2 non-LTR retrotransposon is fused to a protein, a domain, a fusion partner, a target sequence, an antigenic determinant, or any combination thereof. In some embodiments, the modified R2 reverse transcriptase is fused to a protein, a domain, a fusion partner, a target sequence, an antigenic determinant, or any combination thereof. In some embodiments, the modified reverse transcriptase is fused to a protein, a domain, a fusion partner, a target sequence, an antigenic determinant, or any combination thereof. In some embodiments, the variant is fused to a protein, a domain, a fusion partner, a target sequence, an antigenic determinant, or any combination thereof. In some embodiments, the polypeptide having reverse transcriptase activity is fused to a protein, a domain, a fusion partner, a target sequence, an antigenic determinant, or any combination thereof.

In some embodiments, the fused polypeptides, proteins, enzymes, modified enzymes (e.g., modified reverse transcriptase), modified polypeptides, non-naturally occurring enzymes, or variants thereof increase stability (e.g., increase thermostability), increase shelf life, increase active fraction(s), and/or improve purification compared to the wild-type counterpart, naturally occurring enzyme, or unfused polypeptides, proteins, enzymes, or variants thereof. In some embodiments, a modified reverse transcriptase comprises a fusion partner or a carrier protein. In some embodiments, the selection of the fusion protein, domain, fusion partner, target sequence, antigenic determinant, or any combination thereof is based on the mechanism causing reduced or increased stability (e.g., increased thermostability), reduced or increased shelf life, and/or reduced or increased expression level (Costa et al., "Fusion tags for protein solubility, purification and immunogenicity in *Escherichia coli*: the novel Fh8 system. Front Microbiol. 2014 Feb. 19; 5:63). In some embodiments, the fusion tags enhance the solubility of their partner proteins. In some embodiments, the fusion proteins form micelle-like structures. In some embodiments, the micelle-like structures are misfolded or unfolded proteins that are sequestered and protected from the solvent and/or the soluble protein domains face outward. In some embodiments, the fusion partners attract chaperones. In some embodiments, the fusion tag drives its partner protein into a chaperone-mediated folding pathway. In some embodiments, the MBP and/or N-utilization substance (NusA) are two fusion tags that present this mechanism. In some embodiments, the fusion partners have an intrinsic chaperone-like activity. In some embodiments, the hydrophobic patches of the fusion tag interact with partially folded passenger proteins, preventing self-aggregation, and promoting proper folding. In some embodiments, the solubility enhancer partners may play a passive role in the folding of their target proteins, reducing the chances for protein aggregation. In some embodiments, the fusion partners net charges. In some embodiments, the highly acidic fusion partners inhibit protein aggregation. In some embodiments, the fusion is with, but it is not limited to, Fh8, MBP, NusA, Trx, SUMO, GST, SET, GB1, ZZ, HaloTag, SNUT, Skp, T7PK, EspA, Mocr, Ecotin, CaBP, ArsC, IF2-domain I, an expressivity tag, an expressivity tag that is part of IF2-domain I, RpoA, SlyD, Tsf, RpoS, PotD, Crr, msyB, yjgD, rpoD, His6, or any combination thereof. In some embodiments, the fusion enhances protein solubility and/or purification. In some embodiments, the Fh8 may act as an effective solubility enhancer partner and/or robust purification. In some embodiments, the Fh8 fusion tag has an amino acid sequence comprising MPSVQEVEKLLHVLDRNGDGKV-SAEELKAFADD-SKCPLDSNKIKAFIKEHDKNKDGKLDLKELVSI LSS. In some embodiments, the codon optimized sequence comprises ATGCCGTCTGTTCAGGAAGTT-GAAAAACTGCTGCACGTTCTGGACCGTAACGG TGACGGTAAAG TTTCTGCGGAAGAACT-GAAAGCGTTCGCGGACGACTCTAAATGCCCGCT GGACTCTAACAAAAT CAAAGCGTTCAT-CAAAGAACACGACAAAAACAAA-GACGGTAAACTGGACCTGAAAGAACTGG TTTC-TATCCTGTCTTCTTAG. In some embodiments, an enzyme, or a modified enzyme (e.g., modified reverse transcriptase), or a protein (e.g., modified protein), or a polypeptide (e.g., modified polypeptide), or a variant, or a product, or a nucleic acid molecule, or a cDNA molecule, or a template, or an acceptor nucleic acid molecule, or a primer, or an RNA, or a DNA, or a fragment nucleic acid, or a degraded nucleic acid, of the present disclosure may comprise one or more tag(s). In some embodiments, the fragmented or degraded RNA or DNA, or a variant thereof may comprise one or more tag(s). In some embodiments, the R2 reverse transcriptase, or a variant thereof, may comprise one or more tag(s). In some embodiments, the non-LTR retrotransposon protein or polypeptide having reverse transcriptase activity, or a variant thereof, may comprise one or more tag(s). In some embodiments, the cDNA molecule may comprise one or more tag(s). In some embodiments, the tag may be captured on a solid support, facilitating the isolation of the enzyme, or protein, or polypeptide, or a variant, or a product of the present disclosure. In some embodiments, the tag may be biotin that can be recognized by avidin. The affinity tag may include multiple biotin residues for increased binding to multiple avidin molecules. In some embodiments, the tag may include a functional group such as an azido group or an acetylene group, which enables capture through copper(I) mediated click chemistry (see H. C. Kolb and K. B. Sharpless, Drug Discovery Today, 2003, 8(24), 1128-1137). In some embodiments, the tag may include an antigen that may be captured by an antibody bound on a solid support. In some embodiments, the tag may include, but is not limited to, His-tag, His6-tag, Calmodulin-tag, CBP, CYD (covalent yet dissociable NorpD peptide), Strep II, FLAG-tag, HA-tag, Myc-tag, S-tag, SBP-tag, Softag-1, Softag-3, V5-tag, Xpress-tag, Isopeptag, SpyTag, B, HPC (heavy chain of protein C) peptide tags, GST, MBP, biotin, biotin carboxyl carrier protein, glutathione-S-transferase-tag, green fluorescent protein-tag, maltose binding protein-tag, Nus-tag, Strep-tag, thioredoxin-tag, and combinations thereof. In some embodiments, the tagged molecule may be subjected to sequencing.

In some embodiments, a molecular barcode may be attached to any region of a molecule. For example, the molecular barcode may be attached to the 5' or 3' end of a polynucleotide (e.g., DNA, RNA). For example, the target-specific region of the molecular barcode comprises a sequence that is complementary to a sequence in the 5' region of the molecule. The target-specific region of the molecular barcode may also comprise a sequence that is complementary to a sequence in the 3' region of the molecule. In some instances, the molecular barcode is attached a region within a gene or gene product. For example, genomic DNA is fragmented and a sample tag or molecular identifier label is attached to the fragmented DNA. In other instances, an RNA molecule is alternatively spliced and the molecular barcode is attached to the alternatively spliced variants. In another example, the polynucleotide is digested and the molecular barcode is attached to the digested polynucleotide. In another example, the target-specific region of the molecular barcode comprises a sequence that is complementary to a sequence within the molecule.

In some embodiments the method of the present disclosure comprises introducing a biotin moiety or another affinity purification moiety to, for example, a nucleic acid molecule, such as DNA, RNA, or a combination of DNA and RNA. In some embodiments, the method further comprises immobilizing the affinity purification tagged nucleic acid molecule on a solid support. In some embodiments the solid support is a sepharose resin or magnetic beads having an affinity purification material, such as avidin, streptavidin, chitin, glutathione and the like, bound thereto.

In some embodiments, the enzyme, or protein, or polypeptide, or a variant, or a product of the present disclosure may be bound to a solid support. In some embodiments, the fragmented or degraded nucleic acid (e.g., RNA or DNA), or a variant thereof may be bound to a solid support. In some embodiments, the R2 reverse transcriptase, or a variant thereof, may be bound to a solid support. In some embodiments, the non-LTR retrotransposon protein or polypeptide having reverse transcriptase activity, or a variant thereof, may be bound to a solid support. In some embodiments, the cDNA molecule may be bound to a solid support. In some embodiments, the solid support may be glass, plastic, porcelain, resin, sepharose, silica, or other material. In some embodiments, the solid support may be a plate that is substantially flat substrates, gel, microbeads, magnetic beads, membrane, or other suitable shape and size. In some embodiments, the microbeads may have diameter between 10 nm to several millimeters. In some embodiments, the solid support may be non-porous or porous with various density and size of pores. In some embodiments the DNA and/or RNA fragment may be captured on a solid support, unwanted DNA and/or RNA may be washed away. In some embodiments, the DNA and/or RNA fragment may be released from the solid support, for example, by using restriction enzyme.

In some embodiments, the solid support may comprise the target nucleic acid binding region, wherein the target nucleic acid binding region comprises a sequence selected from the group consisting of a gene-specific sequence, an oligo-dT sequence, a random multimer, and any combination thereof. In some embodiments, the solid support further comprises a target nucleic acid or complement thereof. In some embodiments, the solid support comprises a plurality of target nucleic acids or complements thereof comprising from about 0.01% to about 100% of transcripts of a transcriptome of an organism or complements thereof, or from about 0.01% to about 100% of genes of a genome of an organism or complements thereof. In some embodiments, the cellular labels of the plurality of oligonucleotides comprise a first random sequence connected to a second random sequence by a first label linking sequence; and the molecular labels of the plurality of oligonucleotides comprise random sequences. In some embodiments, the solid support is selected from the group consisting of a polydimethylsiloxane (PDMS) solid support, a polystyrene solid support, a glass solid support, a polypropylene solid support, an agarose solid support, a gelatin solid support, a magnetic solid support, a pluronic solid support, and any combination thereof. In some embodiments, the plurality of oligonucleotides comprise a linker comprising a linker functional group, and the solid support comprises a solid support functional group; wherein the solid support functional group and linker functional group connect to each other. In some embodiments, the linker functional group and the solid support functional group are individually selected from the group consisting of C6, biotin, streptavidin, primary amine(s), aldehyde(s), ketone(s), and any combination thereof. In some embodiments, molecular labels of the plurality of oligonucleotides comprise at least 15 nucleotides.

In some embodiments, fusion partners may be removed from their target protein by enzymatic cleavage, chemical cleavage, and/or by using an in vivo cleavage strategy. In some embodiments, proteases may be used for tag removal. In some embodiments, the protease may be an endoprotease, serine protease, factor Xa, enterokinase, alpha-thrombin, a viral protease, tobacco etch virus (TEV), the human rhinovirus 3C protease, SUMO protease, exoprotease, metallocarboxypeptidase, or aminopeptidase. In some embodiments, a fusion tag may be removed by two purification steps. In some embodiments, the initial affinity purification step includes (e.g., via a histidine tag located at the N-terminal of the fusion protein), the purified fusion protein mixed in solution with the endoprotease (e.g., a his-tagged protease) to cleave off the tag. The cleaved target protein may be recovered in the flow-through sample after a second affinity purification step, in which the cleaved fusion tag and the added protease are collected in the eluted sample.

In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) without thermal cycling. In some embodiments, the modified reverse trancriptase, modified enzyme, non-naturally occurring enzyme, or the modified polypeptide having reverse transcriptase activity of the present disclosure shows activity, is capable of template jumping, and/or generate a nucleic acid, cDNA molecule at a temperature ranging from about 25° C. to about 42° C., from about 12° C. to about 42° C., from about 8° C. to about 50° C., from about 4° C. to about 60° C., from about 27° C. to about 35° C., from about 28° C. to about 33° C., from about 29° C. to about 32° C., from about 30° C. to about 37° C., from about 26° C. to about 38° C., from about 30° C. to about 37° C., from about 25° C. to about 32° C., from about 29° C. to about 31° C., from about 27° C. to about 38° C., from about 29° C. to about 38° C. In some embodiments, the non-naturally occurring enzyme, modified reverse trancriptase, modified enzyme, or modified polypeptide having reverse transcriptase activity of the present disclosure shows activity, is capable of template jumping, and/or generate a nucleic acid molecule (e.g., cDNA molecule) at about 30° C., or at about 35° C., or at about 25° C. In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) at a temperature equal to less than about 38° C., equal to less than about 42° C., equal to less than about 50° C., equal to less than about 60° C., equal to less than about 35° C., equal to less than about 30° C., equal to less than about 28° C., equal to less than about 25° C., equal to less than about 20° C., equal to less than about 12° C., equal to less than about 8° C., or equal to less than about 4° C. In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) at a temperature equal to less than about 36° C. In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) at room temperature. In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) at a temperature of at about or of at most about 8° C., at about or of at most about 12° C., at about or of at most about 20° C., at about or of at most about 25° C., at about or of at most about 28° C., at about or of at most about 30° C., at about or of at most about 31° C., at about or of at most about 32° C., at about or of at most about 33° C., at about or of at most about 34° C., at about or of at most about 35° C., at about or of at most about 36° C. at about or of at most about 39° C., at about or of at most about 40° C., at about or of at most about 41° C., at about or of at most about 42° C., at about or of at most about 50° C., at about or of at most about 55° C., at about or of at most about 60° C. In some embodiments, the modified enzyme, modified reverse trancriptase, non-naturally occurring enzyme, or modified polypeptide having reverse transcriptase activity of the present disclosure shows activity, is capable of template jumping, and/or generate a nucleic acid molecule (e.g., cDNA molecule) at a temperature equal to or less than about any temperature between about 42° C. to about 80° C., or between about 35° C. to about 80° C., or between about 30° C. to about 50° C., or between about 8° C. to about 50° C., or between about 12° C. to about 42° C.

In some embodiments, a modified enzyme, modified reverse trancriptase, modified polypeptide having reverse transcriptase activity, or a non-naturally occurring enzyme of the present disclosure has at least one altered characteristic relative to an unmodified or naturally occurring enzyme. In some embodiments, the altered characteristic enables the modified enzyme, modified reverse trancriptase, non-naturally occurring enzyme, or modified polypeptide having reverse transcriptase activity to generate a nucleic acid molecule and/or a complementary deoxyribonucleic acid (cDNA) molecule from a template nucleic acid molecule without thermal cycling. In some embodiments, a modified enzyme, modified reverse trancriptase, modified polypeptide having reverse transcriptase activity, or a non-naturally occurring enzyme of the present disclosure is capable of generating one or more copies of the nucleic acid molecule or cDNA molecule at an error rate of at most about 0.5%, of at most about 1%, of at most about 1.5%, of at most about 2%, of at most about 2.5%, of at most about 3%, of at most about 3.5%, of at most about 4%, of at most about 4.5%, of at most about 5%, of at most about 6%, of at most about 7%, of at most about 8%, of at most about 9%, of at most about 10%, of at most about 15%, of at most about 20%, of at most about 25%, of at most about 30%, of at most about 40%, of at most about 45%, of at most about 50%, of at most about 60%, of at most about 65%, of at most about 70%, of at most about 75%, or of at most about 80%. In some embodiments, the modified enzyme, modified reverse trancriptase, modified polypeptide having reverse transcriptase activity, or the non-naturally occurring enzyme of the present disclosure is a variant of any one of the sequences disclosed herein. In some embodiments, the modified enzyme, modified reverse trancriptase, modified polypeptide having reverse transcriptase activity, or the non-naturally occurring enzyme of the present disclosure is a variant of any one of the sequences corresponding to accession numbers provided in TABLE 1. In some embodiments, the modified enzyme, modified reverse trancriptase, modified polypeptide having reverse transcriptase activity, or the non-naturally occurring enzyme of the present disclosure is a variant of any one of the sequences provided in SEQ ID Nos: 1-67. In some embodiments, a modified enzyme, modified reverse trancriptase, modified polypeptide having reverse transcriptase activity, or a non-naturally occurring enzyme of the present disclosure has at least one altered characteristic that improves enzyme property relative to an unmodified or a naturally occurring enzyme. In some embodiments, the at least one altered characteristic that improves enzyme property comprises at least one of increased/improved stability (e.g., increased/improved thermostability), increased/improved specific activity, increased/improved protein expression, increased/improved purification, increased/improved processivity, increased/improved strand displacement, increased/improved template jumping, and increased/improved fidelity.

In one embodiment, the present disclosure relates to a non-naturally occurring enzyme that subjects a template nucleic acid molecule to reverse transcription to generate a complementary deoxyribonucleic acid (cDNA) product and amplification of the cDNA product at a processivity of at least about 80%, at least about 85%, at least about 87%, at least about 90%, at least about 92%, at least about 95%, at least about 96%, at least about 97%, at least about 98%, at least about 99%, or at least about 99.5% per base as measured at about 12° C., about 15° C., about 20° C., about 25° C., about 30° C., about 32° C., about 35° C., about 40° C.

In some embodiments, the non-naturally occurring enzyme has a performance index greater than about 1.0 for at least one enzyme property. In some embodiments, enzyme property is at least one of the group consisting of improved stability (e.g., improved thermostability), specific activity, protein expression, purification, processivity, strand displacement, template jumping, increased DNA/RNA affinity, and fidelity.

In one embodiment, the present disclosure relates to a non-naturally occurring enzyme that subjects a template nucleic acid molecule to reverse transcription to generate a complementary deoxyribonucleic acid (cDNA) product, a nucleic acid product, and amplification of the cDNA product in a time period of about 3 hours or less and/or at a performance index greater than about 1.0 for at least one enzyme property selected from the group consisting of improved stability (e.g., improved thermostability), specific activity, protein expression, purification, processivity, strand displacement, template jumping, increased DNA/RNA affinity, and fidelity. In some embodiments, the temperature is from about 25° C. to about 40° C. (e.g., about 28° C., about 30° C., about 32° C., about 35° C., or about 37° C.). In some embodiments, the temperature is from about 8° C. to about 50° C. (e.g., about 8° C., about 20° C., about 42° C., about 45° C., or about 50° C.).

In one embodiment, the present disclosure relates to a non-naturally occurring enzyme that subjects a template nucleic acid molecule to reverse transcription to generate a complementary deoxyribonucleic acid (cDNA) product and amplification of the cDNA product in a time period of 3 hours or less (e.g., 2.5 hours or less, 2 hours or less, 1.5 hours or less, 1 hour or less, or 30 minutes or less) and/or at a processivity for a given nucleotide substrate that is at least about 5%, at least about 10%, at least about 20%, at least about 30%, at least about 40%, at least about 50%, at least about 60%, at least about 70%, at least about 80%, at least about 85%, at least about 88%, at least about 90%, at least about 95%, or at least about 98% higher than the processivity of a reference enzyme for the same nucleotide substrate.

In one embodiment, the present disclosure relates to a non-naturally occurring enzyme that subjects a template nucleic acid molecule to reverse transcription to generate a nucleic acid product and amplification of the nucleic acid product in a time period of 3 hours or less (e.g., 2.5 hours or less, 2 hours or less, 1.5 hours or less, 1 hour or less, or 30 minutes or less) and/or at a processivity for a given nucleotide substrate that is at least about 5%, at least about 10%, at least about 20%, at least about 30%, at least about 40%, at least about 50%, at least about 60%, at least about 70%, at least about 80%, at least about 85%, at least about 88%, at least about 90%, at least about 95%, or at least about 98% higher than the processivity of a reference enzyme for the same nucleotide substrate.

In one embodiment, the present disclosure provides a method of amplifying a nucleic acid molecule, comprising subjecting the nucleic acid molecule to nucleic acid amplification using a modified reverse transcriptase. In some embodiments, the reverse transcriptase is capable of amplifying the nucleic acid molecule at processivity of at least about 80%, at least about 88%, at least about 90%, at least about 95%, or at least about 98% per base at about 4° C., about 8° C., about 12° C., about 30° C., about 28° C., about 29° C., about 32° C., about 35° C., about 37° C., about 42° C., about 50° C., or higher than about 42° C.

In some embodiments, the method of the present disclosure further comprises using the modified reverse transcriptase to subject a template nucleic acid molecule to reverse transcription to yield the nucleic acid molecule. In some embodiments, the nucleic acid molecule is a cell-free nucleic acid molecule. In some embodiments, the template nucleic acid molecule is a cell-free nucleic acid molecule.

In some embodiments, primer extension or elongation reactions are utilized to generate amplified product. Primer extension/elongation reactions may comprise a cycle of incubating a reaction mixture at a denaturation temperature for a denaturation duration and incubating a reaction mixture at an elongation temperature for an elongation duration.

Any type of nucleic acid amplification reaction may be used to amplify a target nucleic acid and generate an amplified product. Moreover, amplification of a nucleic acid may linear, exponential, or a combination thereof. Amplification may be emulsion based or may be non-emulsion based. Non-limiting examples of nucleic acid amplification methods include reverse transcription, primer extension, polymerase chain reaction, ligase chain reaction, helicase-dependent amplification, asymmetric amplification, rolling circle amplification, and multiple displacement amplification (MDA). In some embodiments, the amplified product may be DNA. In cases where a target RNA is amplified, DNA can be obtained by reverse transcription of the RNA and subsequent amplification of the DNA can be used to generate an amplified DNA product. The amplified DNA product may be indicative of the presence of the target RNA in the biological sample. In cases where DNA is amplified, any DNA amplification may be employed. Non-limiting examples of DNA amplification methods include polymerase chain reaction (PCR), variants of PCR (e.g., real-time PCR, allele-specific PCR, assembly PCR, asymmetric PCR, digital PCR, emulsion PCR, dial-out PCR, helicase-dependent PCR, nested PCR, hot start PCR, inverse PCR, methylation-specific PCR, miniprimer PCR, multiplex PCR, nested PCR, overlap-extension PCR, thermal asymmetric interlaced PCR, touchdown PCR), and ligase chain reaction (LCR). In some cases, DNA amplification is linear. In some cases, DNA amplification is exponential. In some cases, DNA amplification is achieved with nested PCR, which can improve sensitivity of detecting amplified DNA products.

Denaturation temperatures may vary depending upon, for example, the particular biological sample analyzed, the particular source of target nucleic acid (e.g., viral particle, bacteria) in the biological sample, the reagents used, and/or the desired reaction conditions. In some embodiments, a denaturation temperature may be from about 80° C. to about 110° C. In some embodiments, a denaturation temperature may be from about 90° C. to about 100° C. In some embodiments, a denaturation temperature may be from about 90° C. to about 97° C. In some examples, a denaturation temperature may be from about 92° C. to about 95° C. In still other examples, a denaturation temperature may be about 80°, 81° C., 82° C., 83° C., 84° C. 85° C., 86° C., 87° C., 88° C., 89° C., 90° C., 91° C., 92° C., 93° C., 94° C., 95° C., 96° C., 97° C., 98° C. 99° C., or 100° C.

Denaturation durations may vary depending upon, for example, the particular biological sample analyzed, the particular source of target nucleic acid (e.g., viral particle, bacteria) in the biological sample, the reagents used, and/or the desired reaction conditions. In some embodiments, a denaturation duration may be less than or equal to about 300 seconds, 240 seconds, 180 seconds, 120 seconds, 90 seconds, 60 seconds, 55 seconds, 50 seconds, 45 seconds, 40 seconds, 35 seconds, 30 seconds, 25 seconds, 20 seconds, 15 seconds, 10 seconds, 5 seconds, 2 seconds, or 1 second. For example, a denaturation duration may be no more than about 180 seconds, 120 seconds, 90 seconds, 60 seconds, 55 seconds, 50 seconds, 45 seconds, 40 seconds, 35 seconds, 30 seconds, 25 seconds, 20 seconds, 15 seconds, 10 seconds, 5 seconds, 2 seconds, or 1 second.

Elongation or extension temperatures may vary depending upon, for example, the particular biological sample analyzed, the particular source of target nucleic acid (e.g., viral particle, bacteria) in the biological sample, the reagents used, and/or the desired reaction conditions. In some embodiments, an elongation temperature may be from about 30° C. to about 80° C. In some embodiments, an elongation temperature may be from about 35° C. to about 72° C. In some embodiments, an elongation temperature may be from about 45° C. to about 68° C. In some embodiments, an elongation temperature may be from about 35° C. to about 65° C. In some embodiments, an elongation temperature may be from about 40° C. to about 67° C. In some embodiments, an elongation temperature may be from about 50° C. to about 68° C. In some embodiments, an elongation temperature may be about 0° C., 1°. 2° C., 3° C., 4° C., 5° C. 6° C., 7° C., 8° C., 9° C., 10° C., 11° C., 12° C., 13° C., 14° C., 15° C., 16° C., 17° C., 18° C., 19° C., 34° C., 33° C., 32° C., 31° C., 30° C., 20° C., 21° C., 22° C., 23° C., 24° C., 25° C., 26° C., 27° C., 28° C., 29° C., 35° C., 36° C., 37° C., 38° C., 39° C., 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C. 59° C., 60° C., 61° C., 62° C., 63° C., 64° C., 65° C. 66° C., 67° C., 68° C., 69° C., 70° C., 71° C., 72° C., 73° C., 74° C., 75° C., 76° C., 77° C., 78° C., 79° C., or 80° C.

Elongation durations may vary depending upon, for example, the particular biological sample analyzed, the particular source of target nucleic acid (e.g., viral particle, bacteria) in the biological sample, the reagents used, and/or the desired reaction conditions. In some embodiments, an elongation duration may be less than or equal to about 360 seconds, less than or equal to about 300 seconds, 240 seconds, 180 seconds, 120 seconds, 90 seconds, 60 seconds, 55 seconds, 50 seconds, 45 seconds, 40 seconds, 35 seconds, 30 seconds, 25 seconds, 20 seconds, 15 seconds, 10 seconds, 5 seconds, 2 seconds, or 1 second. In some embodiments, an elongation duration may be no more than about 120 seconds, 90 seconds, 80 seconds, 70 seconds, 65 seconds, 60 seconds, 55 seconds, 50 seconds, 45 seconds, 40 seconds, 35 seconds, 30 seconds, 25 seconds, 20 seconds, 15 seconds, 10 seconds, 5 seconds, 2 seconds, or 1 second.

In some embodiments, multiple cycles of a primer extension reaction can be conducted. Any suitable number of cycles may be conducted. In some embodiments, the number of cycles conducted may be less than about 100, 90, 80, 70, 60, 50, 40, 30, 20, 10, or 5 cycles. The number of cycles conducted may depend upon, for example, the number of cycles (e.g., cycle threshold value (Ct)) necessary to obtain a detectable amplified product (e.g., a detectable amount of amplified DNA product that is indicative of the presence of a target RNA in a biological sample). In some embodiments, the number of cycles necessary to obtain a detectable amplified product (e.g., a detectable amount of DNA product that is indicative of the presence of a target RNA in a biological sample) may be less than about or about 100 cycles, 75 cycles, 70 cycles, 65 cycles, 60 cycles, 55 cycles, 50 cycles, 40 cycles, 35 cycles, 30 cycles, 25 cycles, 20 cycles, 15 cycles, 10 cycles, 8 cycles, 7 cycles, 5 cycles, or 4 cycles. Moreover, in some embodiments, a detectable amount of an amplifiable product (e.g., a detectable amount of DNA product that is indicative of the presence of a target RNA in a biological sample) may be obtained at a cycle threshold value (Ct) of less than 100, 75, 70, 65, 60, 55, 50, 45, 40, 35, 30, 25, 20, 15, 10, 9, 8, 7, 6, 5, 4, 3, 2, 1.

In some embodiments, an amplification step (e.g., primer amplification, template amplification, nucleic acid amplification) comprises a PCR step. In some embodiments, each PCR cycle may comprise a denaturing step, an annealing step, and an extension step. In some embodiments, each PCR cycle may comprise a denaturing step and an extension step. In some embodiments, the PCR comprises at least about or about or at most about 1 cycle, at least about or about or at most about 4 cycles, at least about or about or at most about 5 cycles, at least about or about or at most about 10 cycles, at least about or about or at most about 15 cycles, at least about or about or at most about 20 cycles, at least about or about or at most about 25 cycles, at least about or about or at most about 30 cycles, at least about or about or at most about 35 cycles, at least about or about or at most about 40 cycles, at least about or about or at most about 45 cycles, at least about or about or at most about 50 cycles, at least about or about or at most about 55 cycles, at least about or about or at most about 60 cycles, at least about or about or at most about 65 cycles, at least about or about or at most about 70 cycles, at least about or about or at most about 75 cycles, at least about or about or at most about 80 cycles, at least about or about or at most about 90 cycles, at least about or about or at most about 95 cycles, at least about or about or at most about 100 cycles, at least about or about or at most about 110 cycles, at least about or about or at most about 120 cycles, at least about or about or at most about 130 cycles, at least about or about or at most about 140 cycles, at least about or about or at most about 150 cycles, at least about or about or at most about 160. In some embodiments, the PCR comprises from about 10 cycles to 40 cycles, from about 20 cycles to 40 cycles, from about 20 cycles to 38 cycles, from about 20 cycles to 35 cycles, from about 10 cycles to 35 cycles, from about 10 cycles to 30 cycles, from about 20 cycles to 30 cycles, from about 20 cycles to 30 cycles, from about 4 cycles to 8 cycles, or from about 28 cycles to 32 cycles. In some embodiments, the reaction is heated to 95° C. for 3 minutes before the PCR cycle begins. In some embodiments, each PCR cycle comprises 95° C. for 3 seconds and 62° C. for 20 seconds. In some embodiments, each PCR cycle comprises 95° C. for 3 seconds, 54° C. for 10 seconds, and 64° C. for 20 seconds. In some embodiments, each PCR cycle comprises 95° C. for 3 seconds and 64° C. for 20 seconds. In some embodiments, each PCR cycle comprises 95° C. for 3 seconds and 62° C. for 60 seconds. In some embodiments, each PCR cycle comprises 95° C. for 3 seconds, 54° C. for 10 seconds, and 64° C. for 10 seconds. In some embodiments, the PCR comprises 30 cycles. In some embodiments, the reaction is heated to 68° C. after the completion of the PCR cycles. In some embodiments, the reaction is heated to 68° C. from about 1 second to about 5 seconds, from about 1 second to about 5 minutes, from about 1 minute to about 5 minutes after the completion of the PCR cycles. In some embodiments, the PCR methods described herein comprises an extension or elongation step that is at least about 5 seconds long, at least about 6 seconds long, at least about 7 seconds long, at least about 8 seconds long, at least about 9 seconds long, at least about 10 seconds long, at least about 11 seconds long, at least about 12 seconds long, at least about 13 seconds long, at least about 14 seconds long, at least about 15 seconds long, at least about 20 seconds long, at least about 30 seconds long, at least about 40 seconds long, at least about 50 seconds long, at least about 60 seconds long, at least about 90 seconds long, at least about 120 seconds long, at least about 150 seconds long, at least about 180 seconds long, at least about 210 seconds long, at least about 240 seconds long, at least about 270 seconds long, at least about 300 seconds long, at least about 330 seconds long, at least about 360 seconds long, at least about 390 seconds long, or more.

The time for which amplification yields a detectable amount of amplified product indicative of the presence of a target nucleic acid amplified can vary depending upon the biological sample from which the target nucleic acid was obtained, the particular nucleic acid amplification reactions to be conducted, and the particular number of cycles of amplification reaction desired. In some embodiments, amplification of a target nucleic acid may yield a detectable amount of amplified product indicative to the presence of the target nucleic acid at time period of 120 minutes or less; 90 minutes or less; 60 minutes or less; 50 minutes or less; 45 minutes or less; 40 minutes or less; 35 minutes or less; 30 minutes or less; 25 minutes or less; 20 minutes or less; 15 minutes or less; 10 minutes or less; or 5 minutes or less.

In some embodiments, a biological sample may be preheated prior to conducting a primer extension reaction. The temperature (e.g., a preheating temperature) at which and duration (e.g., a preheating duration) for which a biological sample is preheated may vary depending upon, for example, the particular biological sample being analyzed. In some examples, a biological sample may be preheated for no more than about 60 minutes, 50 minutes, 40 minutes, 30 minutes, 25 minutes, 20 minutes, 15 minutes, 10 minutes, 9 minutes, 8 minutes, 7 minutes, 6 minutes, 5 minutes, 4 minutes, 3 minutes, 2 minutes, 1 minute, 45 seconds, 30 seconds, 20 seconds, 15 seconds, 10 seconds, or 5 seconds. In some examples, a biological sample may be preheated at a temperature from about 80° C. to about 110° C. In some examples, a biological sample may be preheated at a temperature from about 90° C. to about 100° C. In some examples, a biological sample may be preheated at a temperature from about 90° C. to about 97° C. In some examples, a biological sample may be preheated at a temperature from about 92° C. to about 95° C. In some embodiments, a biological sample may be preheated at a temperature of about 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., or 100° C.

In some embodiments, reagents necessary for conducting nucleic acid amplification may also include a reporter agent that yields a detectable signal whose presence or absence is indicative of the presence of an amplified product. The intensity of the detectable signal may be proportional to the amount of amplified product. In some cases, where amplified product is generated of a different type of nucleic acid than the target nucleic acid initially amplified, the intensity of the detectable signal may be proportional to the amount of target nucleic acid initially amplified. For example, in the case of amplifying a target RNA via parallel reverse transcription and amplification of the DNA obtained from reverse transcription, reagents necessary for both reactions may also comprise a reporter agent, may yield a detectable signal that is indicative of the presence of the amplified DNA product, and/or the target RNA amplified. The intensity of the detectable signal may be proportional to the amount of the amplified DNA product and/or the original target RNA amplified. The use of a reporter agent also enables real-time amplification methods, including real-time PCR for DNA amplification.

Reporter agents may be linked with nucleic acids, including amplified products, by covalent or non-covalent linkages or interactions. Non-limiting examples of non-covalent linkates or interactions include ionic interactions, Van der Waals forces, hydrophobic interactions, hydrogen bonding, and combinations thereof. In some embodiments, reporter agents may bind to initial reactants and changes in reporter agent levels may be used to detect amplified product. In some embodiments, reporter agents may only be detectable (or non-detectable) as nucleic acid amplification progresses. In some embodiments, an optically-active dye (e.g., a fluorescent dye) may be used as may be used as a reporter agent. Non-limiting examples of dyes include SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, phenanthridines and acridines, ethidium bromide, propidium iodide, hexidium iodide, dihydroethidium, ethidium homodimer-1 and -2, ethidium monoazide, and ACMA, Hoechst 33258, Hoechst 33342, Hoechst 34580, DAPI, acridine orange, 7-AAD, actinomycin D, LDS751, hydroxystilbamidine, SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red), fluorescein, fluorescein isothiocyanate (FITC), tetramethyl rhodamine isothiocyanate (TRITC), rhodamine, tetramethyl rhodamine, R-phycoerythrin, Cy-2, Cy-3, Cy-3.5, Cy-5, Cy5.5, Cy-7, Texas Red, Phar-Red, allophycocyanin (APC), Sybr Green I, Sybr Green II, Sybr Gold, CellTracker Green, 7-AAD, ethidium homodimer I, ethidium homodimer II, ethidium homodimer III, ethidium bromide, umbelliferone, eosin, green fluorescent protein, erythrosin, coumarin, methyl coumarin, pyrene, malachite green, stilbene, lucifer yellow, cascade blue, dichlorotriazinylamine fluorescein, dansyl chloride, fluorescent lanthanide complexes such as those including europium and terbium, carboxy tetrachloro fluorescein, 5 and/or 6-carboxy fluorescein (FAM), 5- (or 6-) iodoacetamidofluorescein, 5-{[2 (and 3)-5-(Acetylmercapto)-succinyl]amino}fluorescein (SAMSA-fluorescein), lissamine rhodamine B sulfonyl chloride, 5 and/or 6 carboxy rhodamine (ROX), 7-amino-methyl-coumarin, 7-Amino-4-methylcoumarin-3-acetic acid (AMCA), BODIPY fluorophores, 8-methoxypyrene-1,3,6-trisulfonic acid trisodium salt, 3,6-Disulfonate-4-amino-naphthalimide, phycobiliproteins, AlexaFluor 350, 405, 430, 488, 532, 546, 555, 568, 594, 610, 633, 635, 647, 660, 680, 700, 750, and 790 dyes, DyLight 350, 405, 488, 550, 594, 633, 650, 680, 755, and 800 dyes, or other fluorophores.

In some embodiments, a reporter agent may be a sequence-specific oligonucleotide probe that is optically active when hybridized with an amplified product. Due to sequence-specific binding of the probe to the amplified product, use of oligonucleotide probes can increase specificity and sensitivity of detection. A probe may be linked to any of the optically-active reporter agents (e.g., dyes) and may also include a quencher capable of blocking the optical activity of an associated dye. Non-limiting examples of probes that may be useful used as reporter agents include TaqMan probes, TaqMan Tamara probes, TaqMan MGB probes, or Lion probes. In some embodiments, a reporter agent may be a radioactive species. Non-limiting examples of radioactive species include 14C, 123I, 124I, 125I, 131I, 99mTc, 35S, or 3H. In some embodiments, a reporter agent may be an enzyme that is capable of generating a detectable signal. Detectable signal may be produced by activity of the enzyme with its substrate or a particular substrate in the case the enzyme has multiple substrates. Non-limiting examples of enzymes that may be used as reporter agents include alkaline phosphatase, horseradish peroxidase, I2-galactosidase, alkaline phosphatase, β-galactosidase, acetylcholinesterase, and luciferase.

In some embodiments, an amplified product (e.g., amplified DNA product, amplified RNA product) may be detected. Detection of amplified product, including amplified DNA, may be accomplished with any suitable detection method. The particular type of detection method used may depend, for example, on the particular amplified product, the type of reaction vessel used for amplification, other reagents in a reaction mixture, whether or not a reporter agent was included in a reaction mixture, and if a reporter agent was used, the particular type of reporter agent use. Non-limiting examples of detection methods include optical detection, spectroscopic detection, electrostatic detection, electrochemical detection, and the like. Optical detection methods include, but are not limited to, fluorimetry and UV-vis light absorbance. Spectroscopic detection methods include, but are not limited to, mass spectrometry, nuclear magnetic resonance (NMR) spectroscopy, and infrared spectroscopy. Electrostatic detection methods include, but are not limited to, gel based techniques, such as, for example, gel electrophoresis, SDS-PAGE gel. Electrochemical detection methods include, but are not limited to, electrochemical detection of amplified product after high-performance liquid chromatography separation of the amplified products.

In some embodiments, the time required to complete the elements of a method may vary depending upon the particular steps of the method. In some embodiments, an amount of time for completing the elements of a method may be from about 5 minutes to about 120 minutes. In some embodiments, an amount of time for completing the elements of a method may be from about 5 minutes to about 60 minutes. In some embodiments, an amount of time for completing the elements of a method may be from about 5 minutes to about 30 minutes. In some embodiments, an amount of time for completing the elements of a method may be less than or equal to 120 minutes, less than or equal to 90 minutes, less than or equal to 75 minutes, less than or equal to 60 minutes, less than or equal to 45 minutes, less than or equal to 40 minutes, less than or equal to 35 minutes, less than or equal to 30 minutes, less than or equal to 25 minutes, less than or equal to 20 minutes, less than or equal to 15 minutes, less than or equal to 10 minutes, or less than or equal to 5 minutes.

In some embodiments, the reaction may have a pH suitable for producing the product, for primer extension, protein expression, PCR amplication, or template jumping. In some embodiments, the pH of the reaction may range from about 5 to about 9, from about 6 to about 9, from about 7 to about 9, from about 8 to about 9. In some embodiments, the pH range is from about pH 2 to about pH 10, from about pH 4 to about pH 10, from about pH 2 to about pH 8, from about pH 4 to about pH 8, from about pH 5 to about pH 8, from about pH 5 to about pH 7, from about pH 6 to about pH 11, from about pH 6 to about pH 12, from about pH 5 to pH 13, from about pH 5 to about pH 14. In some embodiments, the pH is about 2.0, about 2.5, about 3.0, about 3.5, about 4.0, about 4.5, about 5.0, about 5.5, about 6.0, about 6.5, about 7.0, about 7.5, about 8.0, about 8.5, about 9.0, about 9.5, about 10.0, about 10.5, about 11, about 11.5, about 12, about 12.5 about 13, about 13.5, about 14.

In some embodiments, any method of the present disclosure may comprise a detergent. In some embodiments, the detergent is non-ionic and/or a zwitterionic detergent. In some embodiments, a non-ionic detergent is selected from a group consisting of tween, triton, Triton CF-21, Triton CF-32, Triton DF-12, Triton DF-16, Triton GR-SM, Triton N-101 (Polyoxyethylene branched nonylphenyl ether). Triton QS-15, Triton QS-44, Triton RW-75 (Polyethylene glycol 260 monoChexadecyl/octadecyl) ether and 1-Octadecanol), Triton X-100 (Polyethylene glycol tert-octylphenyl ether), Triton X-102, Triton X-15, Triton X-151, Triton X-200, Triton X-207, Triton X-114, Triton X-165, Triton X-305, Triton X-405 (polyoxyethylene(40) isooctylphenyl ether), Triton X-405 reduced (polyoxyethylene(40) isooctylcyclohexyl ether). Triton X-45 (Polyethylene glycol 4-tert-octylphenyl ether). Triton X-705-70, TWEEN in any form including: TWEEN 20 (Polyoxyethylene sorbitan monolaurate), TWEEN 21 (Polyoxyethylene sorbitan monolaurate), TWEEN 40 (polyoxyethylene(20) sorbitan monopalmitate), TWEEN 60 (Polyethylene glycol sorbitan monostearate), TWEEN 61 (Polyethylene glycol sorbitan monostearate), TWEEN 65 (Polyoxyethylene sorbitan Tristearate), TWEEN 80 (Polyoxyethylene sorbitan monooleate), TWEEN 81 (Polyoxyethylene sorbitan monooleate), TWEEN 85 (polyoxyethylene(20) sorbitan trioleate), Brij, Brij 30 (Polyoxyethylene 4 lauryl ether) Brij 35 (Polyoxyethylene 23 lauryl ether), Brij 52 (Polyoxyethylene 2 cetyl ether). Brij56 (Polyoxyethylene 10 cetyl ether), Brij 58 (Polyoxyethylene 20 cetyl ether), Brij 72 (Polyoxyethylene 2 stearyl ether), Brij 76 (Polyoxyethylene 10 stearyl ether), Brij 78 (Polyoxyethylene 20 stearyl ether), Brij 92 (Polyoxyethylene 2 oleyl ether), Brij 97 (Polyoxyethylene 10 oleyl ether). Brij 98 (Polyoxyethylene 20 oleyl ether), Brij700 (Polyoxyethylene 100 stearyl ether, octyl thioglucoside, maltosides, and combinations thereof.

In some embodiments, any method disclosed herein for producing any molecule according to the present disclosure comprises at least one salt. In some embodiments, the salt is at least one member selected from the group consisting of NaCl, LiCl, AlCl$_3$, CuCl$_2$, MgCl$_2$, InCl$_3$, SnCl$_4$, CrCl$_2$, CrCl$_3$, KCl, Nal, K, TMACl (tetramethyl ammonium chloride), TEACl (tetraethyl ammonium chloride), KSCN, CsSCN, KCH$_3$COO, CH$_3$COONa, C$_5$H$_8$KNO$_4$, C$_5$H$_8$NNaO$_4$, CsCl, and any combination thereof. In some embodiments, any method disclosed herein for producing any molecule according to the present disclosure comprises NaCl. In some embodiments, the conditions sufficient for producing a molecule or a library comprises NaCl. In some embodiments, the reaction may have a salt concentration and/or NaCl suitable for producing a product, for primer extension, protein expression, PCR amplication, or template jumping. In some embodiments, the NaCl concentration is from about 50 mM to about 1000 mM, from about 100 mM to about 500 mM, from about 200 mM to about 300 mM, from about 200 mM to about 600 mM. In some embodiments, the NaCl concentration is at least about, at most about, or about 50 mM, at least about, at most about, or about 100 mM, at least about, at most about, or about 150 mM, at least about, at most about, or about 200 mM, at least about, at most about, or about 250 mM, at least about, at most about, or about 300 mM, at least about, at most about, or about 350 mM, at least about, at most about, or about 400 mM, at least about, at most about, or about 450 mM, at least about, at most about, or about 500 mM, at least about, at most about, or about 550 mM, at least about, at most about, or at least about, at most about, or about 600 mM, at least about, at most about, or about 650 mM, at least about, at most about, or about 700 mM, at least about, at most about, or about 750 mM, at least about, at most about, or about 800 mM, at least about, at most about, or about 850 mM, at least about, at most about, or about 900 mM, at least about, at most about, or about 950 mM or at least about, at most about, or about 1000 mM. In some embodiments, the NaCl may improve enzyme activity and/or template jumping of an enzyme or polypeptide of the present disclosure (e.g., of a reverse transcriptase).

In some embodiments, the reaction may have a nucleotide (e.g. dNTPs) concentration suitable for producing a product, for primer extension, protein expression, PCR amplication, or template jumping. In some embodiments, the total dNTP concentration in a reaction may be from about 50 μM to about 1000 μM, from about 100 μM to about 500 μM, from about 200 μM to about 300 μM, from about 200 μM to about 600 μM. In some embodiments, the total dNTP concentration is at least about, at most about, or about 50 μM, at least about, at most about, or about 100 μM, at least about, at most about, or about 150 μM, at least about, at most about, or about 200 μM, at least about, at most about, or about 250 μM, at least about, at most about, or about 300 μM, at least about, at most about, or about 350 μM, at least about, at most about, or about 400 μM, at least about, at most about, or about 450 μM, at least about, at most about, or about 500 μM, at least about, at most about, or about 550 μM, at least about, at most about, or at least about, at most about, or about 600 μM, at least about, at most about, or about 650 μM, at least about, at most about, or about 700 μM, at least about, at most about, or about 750 µM, at least about, at most about, or about 800 µM, at least about, at most about, or about 850 µM, at least about, at most about, or about 900 µM, at least about, at most about, or about 950 µM, at least about, at most about, or about 1000 µM. In some embodiments, the total concentration of each dNTP is at least about, at most about, or about 1 µM; at least about, at most about, or about 2 µM; at least about, at most about, or about 3 µM; at least about, at most about, or about 4 µM; at least about, at most about, or about 5 µM; at least about, at most about, or about 6 µM; at least about, at most about, or about 7 µM; at least about, at most about, or about 8 µM; at least about, at most about, or about 9 µM; at least about, at most about, or about 10 µM; at least about, at most about, or about 15 µM; at least about, at most about, or about 20 µM; at least about, at most about, or about 25 µM; at least about, at most about, or about 30 µM at least about, at most about, or about 35 µM; at least about, at most about, or about 40 µM; at least about, at most about, or about 45 µM; at least about, at most about, or about 50 µM; at least about, at most about, or about 55 µM; at least about, at most about, or about 60 µM; at least about, at most about, or about 65 PM; at least about, at most about, or about 70 µM; at least about, at most about, or about 75 µM; at least about, at most about, or about 80 µM, at least about, at most about, or about 85 µM; at least about, at most about, or about 90 µM; at least about, at most about, or about 95 µM; at least about, at most about, or about 100 µM; at least about, at most about, or about 250 µM; at least about, at most about, or about 500 µM; at least about, at most about, or about 1000 µM; at least about, at most about, or about 10000 µM. In some embodiments, the total concentration of each dNTP is from about 2 µM to about 5 µM, from about 2 µM to about 10 µM, from about 2 µM to about 20 µM, from about 2 µM to about 50 µM, from about 2 µM to about 100 µM, from about 2 µM to about 250 µM, from about 5 µM to about 10 µM, from about 5 µM to about 50 µM, from about 5 µM to about 250 µM, from about 5 µM to about 1000 µM.

In some embodiments, the concentration of each dNTP may be independent and different from the concentration of one or more dNTP. In some embodiments, the concentration of each dNTP for example the concentration of each dCTP, dGTP, dTTP, or dATP may be independent and different from the concentration of at least one other dNTP. In some embodiments, the concentration of one dNTP (e.g., dCTP, dGTP, dTTP, or dATP) may be at least about or at most about or about 1 fold, 2 fold, 3 fold, 4 fold, 5 fold, 7 fold, 10 fold, 20 fold, 35 fold, 50 fold, 75 fold, 90 fold, 100 fold, 200 fold, 500 fold, or 1000 fold different from at least one other dNTP (e.g., dCTP, dGTP, dTP, or dATP).

In some embodiments, the reaction mixture includes a pH adjusting agent. pH adjusting agents of interest include, but are not limited to, sodium hydroxide, hydrochloric acid, phosphoric acid buffer solution, tris buffer, citric acid buffer solution, and the like. For example, the pH of the reaction mixture can be adjusted to the desired range by adding an appropriate amount of the pH adjusting agent.

The temperature range suitable for production of a product may vary according to factors such as the particular polymerase employed, the melting temperatures of any optional primers employed, etc. In some embodiments, the polymerase may include, but it is not limited to, a reverse transcriptase, a Moloney Murine Leukemia Virus (MMLV) reverse transcriptase, an R2 reverse transcriptase, an RNA-directed DNA polymerase, an DNA-directed DNA polymerase, a non-LTR retrotransposon, an R2 non-LTR retrotransposon, a polypeptide having reverse transcriptase activity, or any variant thereof, or any combination thereof.

In some embodiments, the conditions sufficient to produce a product include bringing the reaction mixture to a temperature ranging from about 4° C. to about 72° C., from about 16° C. to about 70° C., from about 37° C. to about 50° C., from about 40° C. to about 45° C., from about 30° C. to about 42° C., from about 25° C. to about 42° C., from about 25° C. to about 30° C., from about 28° C. to about 32° C., from about 29° C. to about 31° C. In some embodiments, the temperature is about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C. about 46° C., about 47° C., about 48° C. about 49° C., about 50° C., about 51° C., about 52° C., about 53° C., about 54° C., about 55° C., about 56° C., about 57° C., about 58° C., about 59° C., about 60° C., about 61° C., about 62° C., about 63° C., about 64° C., about 65° C., about 66° C., about 67° C., about 68° C., about 69° C., about 70° C., about 71° C., about 72° C., about 73° C., about 74° C., or about 75° C. In some embodiments, the temperature is about or at most about 42° C. In some embodiments, the temperature is about or at most about 50° C. In some embodiments, the temperature is about or at most about 35° C. In some embodiments, the temperature is about or at most about 25° C. In some embodiments, the temperature is about or at most about 30° C. In some embodiments, the reaction is incubated from about 20 minutes to about 3 hours, from about 30 minutes to about 1.5 hours, from about 30 minutes to about 1 hour, from about 30 minutes to about 2 hours, from about 1 hour to about 2 hours, from about 1 hour to about 1.5 hours, from about 30 minutes to about 5 hours, from about 1 hour to about 3 hours, from about 1 hour to about 4 hours, from about 1 hour to about 5 hours. In some embodiments, the reaction is incubated for about 1 hour. In some embodiments, the reaction is incubated for about 20 minutes, about 30 minutes, about 40 minutes, about 50 minutes, about 1 hour, about 1.5 hours, about 2 hours, about 2.5 hours, about 3 hours, about 3.5 hours, about 4 hours, about 4.5 hours, or about 5 hours. In some embodiments, the reaction is incubated for at least at least about 20 minutes, at least about 30 minutes, at least about 40 minutes, at least about 50 minutes, at least about 1 hour, at least about 1.5 hours, at least about 2 hours, at least about 2.5 hours, at least about 3 hours, at least about 3.5 hours, at least about 4 hours, at least about 4.5 hours, or at least about 5 hours. In some embodiments, the reaction is incubated at about 30° C. for about 1 hour, or at about 42° C. for about 1 hour. In some embodiments, the conditions sufficient for generating a molecule or a nucleic acid molecule comprises a temperature of about 12° C. to about 42° C. for about 1 minute to about 5 hours. In some embodiments, the conditions sufficient for generating a molecule or a nucleic acid molecule comprises a temperature of about 8° C. to about 50° C. for about 1 minute to about 24 hours.

In some embodiments, a primer can be designed to be a certain length. In some embodiments, a primer can be from about 6 to about 100 nucleotides, from about 6 to about 90 nucleotides, from about 6 to about 80 nucleotides, from about 6 to about 70 nucleotides, from about 6 to about 60 nucleotides, from about 6 to about 50 nucleotides, from about 6 to about 40 nucleotides, from about 6 to about 30 nucleotides, from about 6 to about 20 nucleotides, or from about 6 to about 10 nucleotides in length. In some embodiments, a primer can be from about 25 to about 80, from about 25 to about 75, from about 25 to about 70, from about 25 to about 65, from about 25 to about 60, from about 25 to about 55, from about 25 to about 50, from about 25 to about 45, from about 25 to about 40, from about 25 to about 35, or from about 25 to about 30 bases in length. In some embodiments, a primer can be at least about 5, at least about 6, at least about 7, at least about 8, at least about 9, at least about 10, at least about 11, at least about 12, at least about 13, at least about 14, at least about 15, at least about 16, at least about 17, at least about 18, at least about 19, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95 or at least about 100 bases in length. In some embodiments, a primer can be about 5, about 6, about 7, about 8, about 9, about 10, about 11, about 12, about 13, about 14, about 15, about 16, about 17, about 18, about 19, about 20, about 25, about 30, about 35, about 40, about 45, about 50, about 55, about 60, about 65, about 70, about 75, about 80, about 85, about 90, about 95 or about 100 bases in length. In some embodiments, a primer can be at least about, no more than about, or about 120, 130, 140, 150, 160, 170, 180, 190, 200, 230, 250, 270, 290, 300, 320, 340, 350, 370, 400, 420, 450, 470, 490, or 500.

In some embodiments, a primer can be designed to anneal to a target at a given melting temperature (Tm). In some embodiments, a Tm can be from about 20° C. to about 100° C., about 20° C. to about 90° C., about 20° C. to about 80° C., about 20° C. to about 70° C., about 20° C. to about 60° C., about 20° C. to about 50° C., about 20° C. to about 40° C., or about 20° C. to about 30° C. In some embodiments, a Tm can be at least about, at most about, or about 20° C., 21° C., 22° C., 23° C., 24° C., 25° C., 26° C., 27° C., 28° C., 29° C., 30° C., 31° C. 32° C., 33° C., 34° C., 35° C., 36° C., 37° C., 38° C. 39° C., 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 83° C., 84° C., 85° C., 96° C. 97° C., 98° C., 99° C., or 100° C. A plurality of primers can be designed to have Tins within a range, e.g., within a range spanning 15° C. 10° C., 9° C., 8° C., 7° C., 6° C., 5° C., 4° C., 3° C., 2° C., or 1° C. A plurality of primers can be designed to have identical Tms.

In some embodiments the enzyme, or modified enzyme (e.g., modified reverse transcriptase), or protein, or polypeptide, or a variant, or a PCR product, or a cDNA molecule, or a template, or a nucleic acid molecule, or any component of the present disclosure may be purified. In some embodiments, the fragmented or degraded nucleic acid (e.g., RNA or DNA) may be purified. In some embodiments, the reverse transcriptase or a modified reverse transcriptase may be purified. In some embodiments, the R2 reverse transcriptase or a modified R2 reverse transcriptase may be purified. In some embodiments, the non-LTR retrotransposon protein or polypeptide having reverse transcriptase activity, or a modified non-LTR retrotransposon protein or a modified polypeptide having reverse transcriptase activity may be further purified. In some embodiments, the cDNA molecule may be purified. In some embodiments, the template may be purified. In some embodiments, the acceptor nucleic acid molecule may be purified.

Purification may comprise precipitation, ultracentrifugation, chromatographic method based on size, charge, hydrophobicity, affinity, metal binding, HPLC. In some embodiments, the purification comprises column chromatography. In some embodiments, the column chromatography may be size exclusion (SEC), ion exchange (IEX), affinity chromatography, immobilized metal ion affinity chromatography (IMAC), Ni-IMAC chromatography, and/or hydrophobic interaction (HIC). In some embodiments, the purification comprises His-tag affinity resin. In some embodiments, the purification may comprise one step. In some embodiments, the purification may comprise two steps. In some embodiments, the two step purification comprises nickel and heparin. In some embodiments, the two step purification comprises nickel and heparin affinity purifications. In some embodiments, the two purification steps provide higher activity and/or increased template jumping compared to one step purification. In some embodiments, the purification comprises heparin-affinity purification. In some embodiments, purification may include affinity purification, Ni-NTA affinity, fast protein liquid chromatography (FPLC) (e.g., AKTA and Bio-Rad FPLC systems), high-pressure liquid chromatography (HPLC) (e.g., Beckman and Waters HPLC). In some embodiments, purification may include, but not limited to, ion exchange chromatography (e.g., Q, S), size exclusion chromatography, salt gradients, affinity purification (e.g., Ni, Co, FLAG, maltose, glutathione, protein A/G), gel filtration, reverse-phase, ceramic HYPERD (Registered trademark) ion exchange chromatography, and hydrophobic interaction columns (HIC). Also included are analytical methods such as SDS-PAGE (e.g., coomassie, silver stain), immunoblot. Bradford, and ELISA, which may be utilized during any step of the production or purification process, typically to measure the purity of the protein or enzyme composition.

In some embodiments, the overall activity of the purified enzyme, protein, polypeptide, the R2 reverse transcriptase, the non-LTR retrotransposon protein or polypeptide having reverse transcriptase activity, the reverse transcriptase, or variants thereof, or products thereof using a two-step purification is at least about 2%, at least about 5%, at least about 7%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99% higher than the overall activity using the one-step purification. In some embodiments, the overall activity of the purified enzyme, protein, polypeptide, the R2 reverse transcriptase, the non-LTR retrotransposon protein or polypeptide having reverse transcriptase activity, the reverse transcriptase, or variants thereof, or products thereof is at least about 0.5%, at least about 1%, at least about 1.5%, at least about 2%, at least about 5%, at least about 7%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99% higher than the overall activity of the non-purified enzyme, protein, polypeptide, R2 reverse transcriptase, non-LTR retrotransposon protein or polypeptide having reverse transcriptase activity, reverse transcriptase, or variants thereof, or products thereof. In some embodiments, a purified enzyme, protein, polypeptide, R2 reverse transcriptase, the non-LTR retrotransposon protein, or polypeptide having reverse transcriptase activity, reverse transcriptase, modified enzyme, modified reverse transcriptase, modified polypeptide having reverse transcriptase activity, or variants thereof, or products thereof is at least about 0.5%, at least about 1%, at least about 3%, at least about or about 5%, at least about or about 10%, at least about or about 15%, at least about or about 20%, at least about or about 25%, at least about or about 30%, at least about or about 35%, at least about or about 40%, at least about or about 45%, at least about or about 50%, at least about or about 55%, at least about or about 60%, at least about or about 61%, at least about or about 62%, at least about or about 63%, at least about or about 64%, at least about or about 65%, at least about or about 66%, at least about or about 67%, at least about or about 68%, at least about or about 69%, at least about or about 70%, at least about or about 71%, at least about or about 72%, at least about or about 73%, at least about or about 74%, at least about or about 75%, at least about or about 76%, at least about or about 77%, at least about or about 78%, at least about or about 79%, at least about or about 80%, at least about or about 81%, at least about or about 82%, at least about or about 83%, at least about or about 84%, at least about or about 85%, at least about or about 86%, at least about or about 87%, at least about or about 88%, at least about or about 89%, at least about or about 90%, at least about or about 91%, at least about or about 92%, at least about or about 93%, at least about or about 94%, at least about or about 95%, at least about or about 96%, at least about or about 97%, at least about or about 98%, or at least about or about 99% pure.

In some embodiments, the purified enzyme, protein, polypeptide, R2 reverse transcriptase, non-LTR retrotransposon protein or polypeptide having reverse transcriptase activity, reverse transcriptase, or variants thereof, or products thereof produces template jumping that is at least about or about one time, at least about or about two times, at least about or about three times, at least about or about four times, at least about or about five times, at least about or about six times, at least about or about seven times, at least about or about eight times, at least about or about nine times, at least about or about ten times, at least about or about fifteen times, at least about or about twenty times, at least about or about twenty five times, at least about or about thirty times, at least about or about forty times, at least about or about fifty times, at least about or about seventy times, at least about or about eighty times, at least about or about ninety times, at least about or about 100 times, at least about or about 150 times, at least about or about 200 times, at least about or about 250 times, at least about or about 300 times, at least about or about 350 times, at least about or about 400 times, at least about or about 500 times, at least about or about 700 times, at least about or about 1000 times, at least about or about 10000 times more and/or higher intensity than the non-purified enzyme, protein, polypeptide, R2 reverse transcriptase, non-LTR retrotransposon protein or polypeptide having reverse transcriptase activity, reverse transcriptase, or variants thereof, or products thereof.

Cell-Free DNA and Circulating Tumor DNA

In some embodiments, obtaining a quantity of circulating tumor (ctDNA) may comprise PCR. In some embodiments, obtaining a quantity of ctDNA may comprise digital PCR. In some embodiments, obtaining a quantity of ctDNA may comprise quantitative PCR. In some embodiments, obtaining a quantity of ctDNA may comprise obtaining sequencing information on the ctDNA. The sequencing information may comprise information relating to one or more genomic regions based. In some embodiments, obtaining the quantity of ctDNA may comprise hybridization of the ctDNA to an array.

Determining the quantity of the cell-free DNA may comprise determining absolute quantities of the cell-free DNA. The quantity of the cell-free DNA may be determined by counting sequencing reads pertaining to the cell-free DNA. The quantity of the cell-free DNA may be determined by quantitative PCR.

Determining quantities of cell-free DNA (cf DNA) may be performed by molecular barcoding of the cfDNA. Molecular barcoding of the cf DNA may comprise attaching adaptors to one or more ends of the cf DNA. The adaptor may comprise a plurality of oligonucleotides. The adaptor may comprise one or more deoxyribonucleotides. The adaptor may comprise ribonucleotides. The adaptor may be single-stranded. The adaptor may be double-stranded. The adaptor may comprise double-stranded and single-stranded portions. For example, the adaptor may be a Y-shaped adaptor. The adaptor may be a linear adaptor. The adaptor may be a circular adaptor. The adaptor may comprise a molecular barcode, sample index, primer sequence, linker sequence or a combination thereof. The molecular barcode may be adjacent to the sample index. The molecular barcode may be adjacent to the primer sequence. The sample index may be adjacent to the primer sequence. A linker sequence may connect the molecular barcode to the sample index. A linker sequence may connect the molecular barcode to the primer sequence. A linker sequence may connect the sample index to the primer sequence.

The adaptor may comprise a molecular barcode. The molecular barcode may comprise a random sequence. The molecular barcode may comprise a predetermined sequence. Two or more adaptors may comprise two or more different molecular barcodes. The molecular barcodes may be optimized to minimize dimerization. The molecular barcodes may be optimized to enable identification even with amplification or sequencing errors. For examples, amplification of a first molecular barcode may introduce a single base error. The first molecular barcode may comprise greater than a single base difference from the other molecular barcodes. Thus, the first molecular barcode with the single base error may still be identified as the first molecular barcode. The molecular barcode may comprise at least 2, 3, 4, 5, 6, 7, 8, 9, 10 or more nucleotides. The molecular barcode may comprise at least 3 nucleotides. The molecular barcode may comprise at least 4 nucleotides. The molecular barcode may comprise less than 20, 19, 18, 17, 16, or 15 nucleotides. The molecular barcode may comprise less than 10 nucleotides. The molecular barcode may comprise less than 8 nucleotides. The molecular barcode may comprise less than 6 nucleotides. The molecular barcode may comprise 2 to 15 nucleotides. The molecular barcode may comprise 2 to 12 nucleotides. The molecular barcode may comprise 3 to 10 nucleotides. The molecular barcode may comprise 3 to 8 nucleotides. The molecular barcode may comprise 4 to 8 nucleotides. The molecular barcode may comprise 4 to 6 nucleotides.

The adaptor may comprise a sample index. The sample index may comprise a random sequence. The sample index may comprise a predetermined sequence. Two or more sets of adaptors may comprise two or more different sample indexes. Adaptors within a set of adaptors may comprise identical sample indexes. The sample indexes may be optimized to minimize dimerization. The sample indexes may be optimized to enable identification even with amplification or sequencing errors. For examples, amplification of a first sample index may introduce a single base error. The first sample index may comprise greater than a single base difference from the other sample indexes. Thus, the first sample index with the single base error may still be identified as the first molecular barcode. The sample index may comprise at least 2, 3, 4, 5, 6, 7, 8, 9, 10 or more nucleotides. The sample index may comprise at least 3 nucleotides. The sample index may comprise at least 4 nucleotides. The sample index may comprise less than 20, 19, 18, 17, 16, or 15 nucleotides. The sample index may comprise less than 10 nucleotides. The sample index may comprise less than 8 nucleotides. The sample index may comprise less than 6 nucleotides. The sample index may comprise 2 to 15 nucleotides. The sample index may comprise 2 to 12 nucleotides. The sample index may comprise 3 to 10 nucleotides. The sample index may comprise 3 to 8 nucleotides. The sample index may comprise 4 to 8 nucleotides. The sample index may comprise 4 to 6 nucleotides.

The adaptor may comprise a primer sequence. The primer sequence may be a PCR primer sequence. The primer sequence may be a sequencing primer.

Adaptors may be attached to one end of the cf DNA. Adaptors may be attached to both ends of the cf DNA. Adaptors may be attached to one or more ends of a single-stranded cf DNA. Adaptors may be attached to one or more ends of a double-stranded cfDNA.

Adaptors may be attached to the cf DNA by ligation. Ligation may be blunt end ligation. Ligation may be sticky end ligation. Adaptors may be attached to the cf DNA by primer extension. Adaptors may be attached to the cf DNA by reverse transcription. Adaptors may be attached to the cf DNA by hybridization. Adaptors may comprise a sequence that is at least partially complementary to the cf DNA. Alternatively, in some instances, adaptors do not comprise a sequence that is complementary to the cf DNA.

The cf-DNA may be derived from a tumor in the subject. The cf-DNA may be derived from any sample of the subject. The cf-DNA may be derived from any organ of the subject. The cf-DNA may be derived from any liquid of the subject (e.g., blood, saliva, urine, and mucus). The method may further comprise detecting a cancer in the subject based on the detection of the cf-DNA.

In some embodiments, the presence or absence of a sequence can be linked to a DNA or RNA profile or to a cancer. For example, the presence or absence of a sequence, can be linked to a transcription profile, microRNA profile, cancer profile, or genomic mutation profile of a sample, such as a single cell. In some embodiments, cfDNA can be used for cancer profiling, and/or monitoring a condition progression, and/or monitoring the occurrence of previous and new mutations. The method may further comprise diagnosing a cancer in the subject based on the detection of the cf-DNA. Diagnosing the cancer may have a sensitivity of at least about 50%, 52%, 55%, 57%, 60%, 62%, 65%, 67%, 70%, 72%, 75%, 77%, 80%, 82%, 85%, 87% 89%, 90%, 91%, 92%, 93%, 94%, 95%, 96%, 97%, or 99%. Diagnosing the cancer may have a specificity of at least about 50%, 52%, 55%, 57%, 60%, 62%, 65%, 67%, 70%, 72%, 75%, 77%, 80%, 82%, 85%, 87%, 89%, 90%, 91%, 92%, 93%, 94%, 95%, 96%, 97%, or 99%. The method may further comprise prognosing a cancer in the subject based on the detection of the cf-DNA. Prognosing the cancer may have a sensitivity of at least about 50%, 52%, 55%, 57%, 60%, 62%, 65%, 67%, 70%, 72%, 75%, 77%, 80%, 82%, 85%, 87%, 89%, 90%, 91%, 92%, 93%, 94%, 95%, 96%, 97%, or 99%. Prognosing the cancer may have a specificity of at least about 50%, 52%, 55%, 57%, 60%, 62%, 65%, 67%, 70%, 72%, 75%, 77%, 80%, 82%, 85%, 87%, 89%, 90%, 91%, 92%, 93%, 94%, 95%, 96%, 97%, or 99%. The method may further comprise determining a therapeutic regimen for the subject based on the detection of the cf-DNA. The method may further comprise administering an anti-cancer therapy to the subject based on the detection of the cf-DNA. The method may further comprise detecting mutations (e.g., mutations at specific regions) based on the sequencing information. Diagnosing the cancer may be based on the detection of mutations. The detection of at least 3 mutations may be indicative of the cancer. The detection of one or more mutations in three or more regions may be indicative of the cancer.

Mutation of Enzymes

In some embodiments, a modified enzyme, or derivatives and variants may be prepared during synthesis of the peptide or by post-production modification. In some embodiments, a modified enzyme, or derivatives and variants may be produced by site-directed mutagenesis (e.g. Q5® Site-Directed Mutagenesis Kit Protocol), random mutagenesis, or enzymatic cleavage and/or ligation of nucleic acids. In some embodiments, the derivatives and variants, or a modified enzyme are produced by random mutagenesis. In some embodiments, a rational design and/or mutagenesis is based on sequence alignment analysis. In some embodiments, the rational design/mutagenesis is based on sequence alignment analysis with defined and known enzymes and proteins. In some embodiments, sequence alignment analysis is performed with enzymes and/or elements with homology to R2, including, but not limited to, non-LTR retrotransposons, telomerase, group 11 introns, LTR retrotransposons, reverse transcriptase, retroviral reverse transcriptase (e.g., HIV, MMLV), and viral RNA dependent RNA polymerase.

In some embodiments, variants or modified enzymes of the present disclosure can be produced by, including, but not limited to, for example, site-saturation mutagenesis, scanning mutagenesis, insertional mutagenesis, deletion mutagenesis, random mutagenesis, site-directed mutagenesis, and directed-evolution, as well as various other recombinatorial approaches. Methods for making modified enzymes, polynucleotides and proteins (e.g., variants) include DNA shuffling methodologies, methods based on non-homologous recombination of genes, such as ITCHY (See, Ostermeier et al., 7:2139-44 [1999]), SCRACHY (See, Lutz et al. 98:11248-53 [2001]). SHIPREC (See, Sieber et al., 19:456-60 [2001]), and NRR (See, Bittker et al., 20:1024-9 [2001]; Bittker et al., 101:7011-6 [2004]), and methods that rely on the use of oligonucleotides to insert random and targeted mutations, deletions and/or insertions (See, Ness et al., 20:1251-5 [2002], Coco et al., 20:1246-50 [2002]; Zha et al., 4:34-9 [2003]; Glaser et al., 149:3903-13 [1992]). In some embodiments, polynucleotides, polypeptides, proteins, or enzymes of the present disclosure may be altered by being subjected to random mutagenesis by error-prone PCR, random nucleotide insertion or other methods prior to recombination. Polynucleotides, polypeptides, proteins, or enzymes of the present disclosure may be produced by DNA shuffling, gene-shuffling, motif-shuffling, exon-shuffling, and/or codon-shuffling (collectively referred to as "DNA shuffling"). DNA shuffling involves the assembly of two or more DNA segments by homologous or site-specific recombination to generate variation in the polynucleotide sequence. DNA shuffling may be employed to modulate the activities of polynucleotides, polypeptides, proteins, or enzymes of the present disclosure, such methods can be used to generate polypeptides with altered activity. See, generally, U.S. Pat. Nos. 5,605,793; 5,811,238; 5,830,721; 5,834,252; 5,837,458; and 6,444,468; and Patten et al., Curr. Opinion Biotechnol. 8:724-33 (1997); Harayama, Trends Biotechnol. 16(2):76-82 (1998); Hansson, et al., J. Mol. Biol. 287:265-76 (1999); and Lorenzo and Blasco, Biotechniques 24(2): 308-13 (1998). Polynucleotides, polypeptides, proteins, or enzymes of the present disclosure may contain one or more components, motifs, sections, parts, domains, fragments, etc., of a polynucleotide, polypeptide, protein, or enzyme of the present disclosure. In some embodiments, kits for use in mutagenic PCR, such as, for example, the Diversify PCR Random Mutagenesis Kit (Clontech) or the GeneMorph Random Mutagenesis Kit (Stratagene) may be used.

In some embodiments, variant proteins differ from a parent protein or modified enzymes differ from a wild-type or unmodified enzyme and one another by a small number of amino acid residues. The number of differing amino acid residues may be one or more, preferably about 1, 2, 3, 4, 5, 10, 15, 20, 30, 40, 50, 60, 70, 80, 90, 100 or more amino acid residues. In some embodiments, the number of different amino acids between variants is between about 1 and about 10. In some embodiments, related proteins and particularly variant proteins comprise at least about 35%, 40%, 45%, 50%, 55%, 60%, 65%, 70%, 75%, 80%, 85%, 90%, 95%, 97%, 98%, or 99% amino acid sequence identity. Additionally, a related protein or a variant protein as used herein, refers to a protein that differs from another related protein or a parent protein in the number of prominent regions. For example, in some embodiments, variant proteins have about 1, 2, 3, 4, 5, 6, 7, 8, 9, or 10 corresponding prominent regions that differ from the parent protein.

In some embodiments, screening methods can include conventional screening methods such as liquid phase, or microtiter plate based assays. The format for liquid phase assays is often robotically manipulated 96, 384, or 1536-well microtiter plates. Other screening methods include growth selection (Snustad et al., 1988; Lundberg et al., 1993; Yano et al., 1998), colorimetric screening of bacterial colonies or phage plaques (Kuritz, 1999), in vitro expression cloning (King et al., 1997) and cell surface or phage display (Benhar, 2001). In some embodiments, screening approaches may be a method selected from yeast-2-hybrid, n-hybrid, reverse-2-hybrid, reverse n-hybrid, split two hybrid, bacterial display, phage display, retroviral display, ribosome display, covalent display, in vitro display, or any other display method. In some embodiments, the library is screened using a phage display method.

Analysis of the sequences derived from template jumps: the band corresponding to the template jump product may be excised from a polyacrylamide gel, eluted with sodium acetate (e.g. 0.3 M sodium acetate, pH 5.2), SDS (e.g. 0.03%) for several hours at room temperature, phenol/chloroform extracted and ethanol precipitated. The isolated cDNA may then be used as a template for PCR amplification using one or more primer(s). The PCR products may then be directly cloned into a vector (Burke et al., "R4, a non-LTR Retrotransposon Specific to the Large Subunit rRNA Gene of Nematodes," Nucleic Acids Res. 23: 4628-4634 (1995)) and individual clones sequenced.

Kits

Any of the compositions described herein may be comprised in a kit. In a non-limiting example, the kit, in a suitable container, comprises one or more primer(s). The kit can also comprise a computer readable medium, e.g., non-transitory computer readable medium. The kit can also comprise reaction components for primer extension and amplification (e.g., dNTPs, polymerase, buffers). The kit can include reagents for library formation (e.g., primers (probes), dNTPs, polymerase, and enzymes). The kit may also comprise approaches for purification, such as a bead suspension. The kit can include reagents for sequencing, e.g., fluorescently labelled dNTPs, sequencing primers, etc.

In some embodiments, some of the components of the kit may be packaged either in aqueous media or in lyophilized form. The containers of the kits can include at least one vial, test tube, flask, bottle, syringe or other containers, into which a component may be placed and suitably aliquotted. Where there is more than one component in the kit, the kit also can contain a second, third or other additional container into which the additional components may be separately placed. Various combinations of components may be comprised in a container. In some embodiments, various combinations of components may be comprised in a vial. The kits of the present disclosure may also contain the components in close confinement for commercial sale. Such containers may include injection or blow molded plastic containers into which the desired vials are retained.

When the components of the kit are provided in one or more liquid solutions, the liquid solution can be an aqueous solution. The components of the kit may be provided as dried powder(s). When reagents and/or components are provided as a dry powder, the powder can be reconstituted by the addition of a suitable solvent.

A kit can include instructions for employing the kit components as well the use of any other reagent not included in the kit. Instructions may include variations that can be implemented.

In some embodiments, reagents and materials include primers for amplifying desired sequences, nucleotides, suitable buffers or buffer reagents, salt, and so forth, and in some cases the reagents include apparatus or reagents for isolation of a particular desired cell(s). In some embodiments, there are one or more apparatuses in the kit suitable for extracting one or more samples from an individual. The apparatus may be a syringe, fine needles, scalpel, and so forth.

In some embodiments, a kit may be used for the preparation of cDNA from a template (e.g. RNA template). Such a kit may include a carrier device compartmentalized to receive one or more containers, such as vials, tubes, and the like, each of which includes one of the separate elements used to prepare cDNA from RNA. For example, there may be provided a first container, the contents of which include a reverse transcriptase (e.g. non-retroviral reverse transcriptase, non-LTR retrotransposon, R2 reverse transcriptase) or variants thereof, in a liquid solution, powder form, or lyophilized form. Further, any number of additional containers can be provided, the contents of which independently include suitable buffers, substrates for nucleotide synthesis such as the deoxynucleotide triphosphates (e.g., dATP, dCTP, dGTP, and dTTP) either individually or collectively in a suitable solution, a template (e.g. template RNA), one or more primer(s), and acceptor nucleic acid molecule (e.g. acceptor RNA), and optionally a terminal transferase in solution. In some embodiments, a kit may comprise a fragment or degraded nucleic acid, DNA, RNA, or a combination thereof, one of more primer(s), an acceptor nucleic acid molecule (e.g., an acceptor nucleic acid molecule comprising a modified nucleotide), a reverse transcriptase (e.g., non-retroviral reverse transcriptase, non-LTR retrotransposon, R2 reverse transcriptase) or variants thereof, suitable buffers, substrates for nucleotide synthesis such as the deoxynucleotide triphosphates (e.g., dATP, dCTP, dGTP, and dTTP). Any combinations of the above components can be provided. Any of the above components may be excluded from the kit. In some embodiments, the one or more primer(s) may be one or more random primer(s). In some embodiments, any of the components may be individually packed.

Target Molecule

In some instances, the molecules are DNA, RNA, or DNA-RNA hybrids. The molecules may be single-stranded or double-stranded. In some embodiments, the molecules are RNA molecules, such as mRNA, rRNA, tRNA, ncRNA, lcRNA, siRNA, microRNA or miRNA. The RNA molecules may be polyadenylated. Alternatively, the mRNA molecules are not polyadenylated. Alternatively, the molecules are DNA molecules. The DNA molecules may be genomic DNA. The DNA molecules may comprise exons, introns, untranslated regions, or any combination thereof. In some embodiments, the molecules ar a panel of molecules.

In some embodiments, the molecule is a fragment or degraded molecule. In some embodiments, the fragment or degraded molecule is a fragment DNA, degraded DNA, fragment RNA, degraded RNA, or combinations thereof. In some embodiments, the molecule is a template nucleic acid (e.g., template DNA, RNA, or combinations thereof). In some embodiments, the molecule is a nucleic acid. In some embodiments, the total amount of a molecule is from about 1 femtomolar (fM) to about 100 micromolar, from about 40 femtomolar to about 0.01 micromolar, from about 50 femtomolar to about 500 femtomolar, from about 50 femtomolar to about 0.01 micromolar, from about 50 femtomolar to about 0.1 micromolar, from about 50 femtomolar to about 500 picomolar, from about 50 femtomolar to about 500 nanomolar, from about 50 femtomolar to about 500 micromolar, from about 50 femtomolar to about 1 picomolar, from about 40 femtomolar to about 1 nanomolar, from about 1 femtomolar to about 1 picolomar, from about 0.1 nM to about 100 nM. In some embodiments, the total about of a molecule is equal to or lower than about 1000 micromolar, equal to or lower than about 500 micromolar, equal to or lower than about 250 micromolar, equal to or lower than about 100 micromolar, equal to or lower than about 50 micromolar, equal to or lower than about 25 micromolar, equal to or lower than about 10 micromolar, equal to or lower than about 1 micromolar, equal to or lower than about 0.1 micromolar, equal to or lower than about 0.01 micromolar, equal to or lower than about 0.001 micromolar, equal to or lower than about 0.0001 micromolar, equal to or lower than about 2000 nanomolar, equal to or lower than about 500 nanomolar, equal to or lower than about 250 nanomolar, equal to or lower than about 200 nanomolar, equal to or lower than about 50 nanomolar, equal to or lower than about 25 nanomolar, equal to or lower than about 20 nanomolar, equal to or lower than about 2 nanomolar, equal to or lower than about 0.2 nanomolar, equal to or lower than about 0.01 nanomolar, equal to or lower than about 0.001 nanomolar, equal to or lower than about 0.0001 nanomolar, equal to or lower than about 3000 picomolar, equal to or lower than about 500 picomolar, equal to or lower than about 250 picomolar, equal to or lower than about 300 picomolar, equal to or lower than about 50 picomolar, equal to or lower than about 25 picomolar, equal to or lower than about 30 picomolar, equal to or lower than about 3 picomolar, equal to or lower than about 0.3 picomolar, equal to or lower than about 0.01 picomolar, equal to or lower than about 0.001 picomolar, equal to or lower than about 0.0001 picomolar, equal to or lower than about 5000 femtomolar, equal to or lower than about 500 femtomolar, equal to or lower than about 250 femtomolar, equal to or lower than about 50 femtomolar, equal to or lower than about 25 femtomolar, equal to or lower than about 10 femtomolar, equal to or lower than about 1 femtomolar, equal to or lower than about 0.1 femtomolar, equal to or lower than about 0.01 femtomolar, equal to or lower than about 0.001 femtomolar, equal to or lower than about 0.0001 femtomolar.

The methods and kits disclosed herein may be used to stochastically label individual occurrences of identical or nearly identical molecules and/or different molecules. In some instances, the methods and kits disclosed herein may be used to stochastically label identical or nearly identical molecules (e.g., molecules comprise identical or nearly identical sequences). For example, the molecules to be labeled comprise at least about 80%, 85%, 90%, 95%, 96%, 97%, 98%, 99%, or 100% sequence identity. The nearly identical molecules may differ by less than about 100, 90, 80, 70, 60, 50, 40, 30, 25, 20, 25, 10, 9, 8, 7, 6, 5, 4, 3, 2, or 1 nucleotide or base pair. The plurality of nucleic acids in one or more samples of the plurality of samples may comprise two or more identical sequences. At least about 1%, 2%, 3%, 4%, 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, 97%, or 100% of the total nucleic acids in one or more of the plurality of samples may comprise the same sequence. The plurality of nucleic acids in one or more samples of the plurality of samples may comprise at least two different sequences. At least about 5%, 10%, 15%, 20%, 25%, 30%, 35%, 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 100% of the total nucleic acids in one or more of the plurality of samples may comprise at least two different sequences. In some instances, the molecules to be labeled are variants of each other. In some embodiments, the molecules to be labeled are fragment or degraded nucleic acid (e.g., DNA or RNA). In some embodiments, the molecules to be labeled are unknown. In some embodiments, the molecules to be labeled are in the femtomolar range, nanomolar range, micromolar range, or millimolar range. In some embodiments, the molecules to be labeled may contain single nucleotide polymorphisms or other types of mutations. In some embodiments, the molecules to be labeled are splice variants. In some embodiments, at least one molecule is stochastically labeled. In some embodiments, at least about 2, 3, 4, 5, 6, 7, 8, 9, or 10 identical or nearly identical molecules are stochastically labeled. In some embodiments, at least about 20, 30, 40, 50, 60, 70, 80, 90, 100, 200, 300, 400, 500, 600, 700, 800, 900, or 1000 identical or nearly identical molecules are stochastically labeled. In some embodiments, at least 1500; 2,000; 2500; 3,000; 3500; 4,000; 4500; 5,000; 6,000; 7,000; 8,000; 9,000; or 10000 identical or nearly identical molecules are stochastically labeled. In some embodiments, at least 15,000; 20.000; 25,000; 30,000; 35,000; 40.000; 45,000; 50,000; 60,000; 70,000; 80,000; 90,000; or 100,000 identical or nearly identical molecules are stochastically labeled. In some embodiments, the one or more molecules are detected. In some embodiments, the one or more molecules are sequenced. In some embodiments, one or more unknown molecules present in the femtomolar range is amplified (e.g. by PCR), and/or labeled, and/or detected, and/or sequenced. In some embodiments, the one or more unknown molecules is indicative of a disease. In some embodiments, the one or more unknown molecules present in the femtomolar range is indicative of a disease. In some embodiments, the disease is cancer or tumor.

In some embodiments, the methods and kits disclosed herein may be used to stochastically label different molecules. For example, the molecules to be labeled comprise less than about 75%, 70%, 65%, 60%, 55%, 50%, 45%, 40%, 35%, 30%, 25%, 20%, 15%, 10%, 5%, 4%, 3%, 2%, 1% sequence identity. The different molecules may differ by at least about 1, 2, 3, 4, 5, 6, 7, 8, 9, 10, 15, 20, 25, 30, 40, 50, 60, 70, 80, 90, 100 or more nucleotides or base pairs. In some instances, at least one molecule is stochastically labeled. In some embodiments, at least 2, 3, 4, 5, 6, 7, 8, 9, or 10 different molecules are stochastically labeled. In some embodiments, at least about 20, 30, 40, 50, 60, 70, 80, 90, 100, 200, 300, 400, 500, 600, 700, 800, 900, or 1000 different molecules are stochastically labeled. In some embodiments, at least about 1500, 2000, 2500, 3000, 3500, 4000, 4500, 5000, 6000, 7000, 8000, 9000, or 10000 different molecules are stochastically labeled. In some embodiments, at least 15000, 20000, 25000, 30000, 35000, 40000, 45000, 50000, 60000, 70000, 80000, 90000, or 100000 different molecules are stochastically labeled. In some embodiments, the molecules are sequenced.

In some embodiments, the different molecules to be labeled may be present in the sample at different concentrations or amounts. For example, the concentration or amount of one molecule may be greater than the concentration or amount of another molecule in the sample. In some embodiments, the concentration or amount of at least one molecule in the sample is at least about 1.5, 2, 3, 4, 5, 6, 7, 8, 9, 10, 11, 12, 13, 14, 15, 20, 25, 30, 35, 40, 45, 50, 60, 70, 80, 90, or 100 or more times greater than the concentration or amount of at least one other molecule in the sample. In some embodiments, the concentration or amount of at least one molecule in the sample is at least about 1000 or more times greater than the concentration or amount of at least one other molecule in the sample. In some embodiments, the concentration or amount of one molecule is less than the concentration or amount of another molecule in the sample. In some embodiments, the concentration or amount of at least one molecule in the sample may be at least about 1.5, 2, 3, 4, 5, 6, 7, 8, 9, 10, 11, 12, 13, 14, 15, 20, 25, 30, 35, 40, 45, 50, 60, 70, 80, 90, or 100 or more times less than the concentration or amount of at least one other molecule in the sample. In some embodiments, the concentration or amount of at least one molecule in the sample may be at least about 1000 or more times less than the concentration or amount of at least one other molecule in the sample.

In some embodiments, the molecules to be labeled are in one or more samples. The molecules to be labeled may be in two or more samples. The two or more samples may contain different amounts or concentrations of the molecules to be labeled. In some embodiments, the concentration or amount of one molecule in one sample may be greater than the concentration or amount of the same molecule in a different sample. In some embodiments, a blood sample may contain a higher amount of a particular molecule than a urine sample. In some embodiments, a single sample is divided into two or more subsamples. The subsamples may contain different amounts or concentrations of the same molecule. The concentration or amount of at least one molecule in one sample may be at least about 1.5, 2, 3, 4, 5, 6, 7, 8, 9, 10, 11, 12, 13, 14, 15, 20, 25, 30, 35, 40, 45, 50, 60, 70, 80, 90, or 100 or more times greater than the concentration or amount of the same molecule in another sample. In some embodiments, the concentration or amount of one molecule in one sample may be less than the concentration or amount of the same molecule in a different sample. For example, a skin tissue sample may contain a higher amount of a particular molecule than a lung tissue sample. The concentration or amount of at least one molecule in one sample may be at least about 1.5, 2, 3, 4, 5, 6, 7, 8, 9, 10, 11, 12, 13, 14, 15, 20, 25, 30, 35, 40, 45, 50, 60, 70, 80, 90, or 100 or more times less than the concentration or amount of the same molecule in another sample.

In some embodiments, the methods and kits disclosed herein may be used for the analysis of one or more molecules from two or more samples. The one or more molecules may comprise one or more polypeptides. The method may comprise determining the identity of one or more labeled polypeptides. Determining the identity of one or more labeled polypeptides may comprise mass spectrometry. The method may further comprise combining the labeled polypeptides of the first sample with the labeled polypeptides of the second sample. The labeled polypeptides may be combined prior to determining the number of different labeled polypeptides. The method may further comprise combining the first sample-tagged polypeptides and the second sample-tagged polypeptides. The first sample-tagged polypeptides and the second sample-tagged polypeptides may be combined prior to contact with the plurality of molecular identifier labels. Determining the number of different labeled polypeptides may comprise detecting at least a portion of the labeled polypeptide. Detecting at least a portion of the labeled polypeptide may comprise detecting at least a portion of the sample tag, molecular identifier label, polypeptide, or a combination thereof. In some embodiments, the detectable tag comprises an L-DNA polynucleotide sequence.

Sequencing

In some embodiments, determining the number of different labeled nucleic acids may comprise determining the sequence of the labeled nucleic acid or any product thereof (e.g., labeled-amplicons, labeled-cDNA molecules). In some embodiments, an amplified target nucleic acid may be subjected to sequencing. Determining the sequence of the labeled nucleic acid or any product thereof may comprise conducting a sequencing reaction to determine the sequence of at least a portion of the sample tag, molecular identifier label, at least a portion of the labeled nucleic acid, a complement thereof, a reverse complement thereof, or any combination thereof. In some embodiments, only the sample tag or a portion of the sample tag is sequenced. In some embodiments, only the molecular identifier label or a portion of the molecular identifier label is sequenced.

Determining the sequence of the labeled nucleic acid or any product thereof may be performed by sequencing methods such as Helioscope (Registered Trademark) single molecule sequencing, Nanopore DNA sequencing, Lynx Therapeutics' Massively Parallel Signature Sequencing (MPSS), 454 pyrosequencing, Single Molecule real time (RNAP) sequencing, Illumina (Solexa) sequencing, SOLiD sequencing, Ion Torrent, Ion semiconductor sequencing, Single Molecule SMRT (Registered Trademark) sequencing, Polony sequencing, DNA nanoball sequencing, and VisiGen Biotechnologies approach. Alternatively, determining the sequence of the labeled nucleic acid or any product thereof may use sequencing platforms, including, but not limited to, Genome Analyzer IIx, HiSeq, and MiSeq offered by Illumina, Single Molecule Real Time (SMRT (Registered Trademark)) technology, such as the PacBio RS system offered by Pacific Biosciences (California) and the Solexa Sequencer, True Single Molecule Sequencing (tSMS (Registered Trademark)) technology such as the HeliScope (Registered Trademark) Sequencer offered by Helicos Inc. (Cambridge, Mass.). In some embodiments, the sequencing reaction can occur on a solid or semi-solid support, in a gel, in an emulsion, on a surface, on a bead, in a drop, in a continuous follow, in a dilution, or in one or more physically separate volumes.

Sequencing may comprise sequencing at least about 10, 20, 30, 40, 50, 60, 70, 80, 90, 100 or more nucleotides or base pairs of the labeled nucleic acid. In some embodiments, sequencing comprises sequencing at least about 200, 300, 400, 500, 600, 700, 800, 900, 1000 or more nucleotides or base pairs of the labeled nucleic acid. In other embodiments, sequencing comprises sequencing at least about 1500; 2,000; 3,000; 4,000; 5,000; 6,000; 7,000; 8,000; 9,000; or 10,000 or more nucleotides or base pairs of the labeled nucleic acid.

Sequencing may comprise at least about 200, 300, 400, 500, 600, 700, 800, 900, 1000 or more sequencing reads per run. In some instances, sequencing comprises sequencing at least about 1500; 2,000; 3,000; 4.000; 5,000; 6,000; 7,000; 8,000; 9,000; or 10,000 or more sequencing reads per run. Sequencing may comprise less than or equal to about 1,600,000,000 sequencing reads per run. Sequencing may comprise less than or equal to about 200,000,000 reads per run.

Cells

The cell as described in the present disclosure may be a cell from an animal (e.g., human, rat, pig, horse, cow, dog, mouse). In some instances, the cell is a human cell. The cell may be a fetal human cell. The fetal human cell may be obtained from a mother pregnant with the fetus. The cell may be a cell from a pregnant mother. The cell may be a cell from a vertebrate, invertebrate, fungi, archae, or bacteria. The cell may be from a multicellular tissue (e.g., an organ (e.g., brain, liver, lung, kidney, prostate, ovary, spleen, lymph node, thyroid, pancreas, heart, skeletal muscle, intestine, larynx, esophagus, and stomach), a blastocyst). The cell may be a cell from a cell culture. The cell may be a HeLa cell, a K562 cell, a Ramos cell, a hybridoma, a stem cell, an undifferentiated cell, a differentiated cell, a circulating cell, a CHO cell, a 3T3 cell, and the like.

Circulating diseased cells that can be used in the methods of the present disclosure include all types of circulating cells that may be affected by a disease or condition or infected by an infectious agent. A circulating cell refers to a cell present in the bodily fluid. A circulating cell may not necessarily circulate throughout the entire body or in the circulatory system. For example, a circulating cell may be present locally, such as in synovial fluid, or cerebrospinal fluid, or lymph fluid. A circulating diseased cell may also be detached from a tissue or organ that has been affected by a disease or condition or infected by an infectious agent. In other embodiments, the circulating diseased cells can be a mixture of different types of circulating diseased cells.

In some embodiments, the cell is a cancerous cell. Non-limiting examples of cancer cells may include a prostate cancer cell, a breast cancer cell, a colon cancer cell, a lung cancer cell, a brain cancer cell, and an ovarian cancer cell. In some embodiments, the cell is from a cancer (e.g., a circulating tumor cell). Non-limiting examples of cancers may include, adenoma, adenocarcinoma, squamous cell carcinoma, basal cell carcinoma, small cell carcinoma, large cell undifferentiated carcinoma, chondrosarcoma, and fibrosarcoma.

In some embodiments, the cell is a rare cell. A rare cell can be a circulating tumor cell (CTC), circulating epithelial cell (CEC), circulating stem cell (CSC), stem cells, undifferentiated stem cells, cancer stem cells, bone marrow cells, progenitor cells, foam cells, fetal cells, mesenchymal cells, circulating endothelial cells, circulating endometrial cells, trophoblasts, immune system cells (host or graft), connective tissue cells, bacteria, fungi, or pathogens (for example, bacterial or protozoa), microparticles, cellular fragments, proteins and nucleic acids, cellular organelles, other cellular components (for example, mitochondria and nuclei), and viruses.

In some embodiments, the cell is from a tumor. In some embodiments, the tumor is benign or malignant. The tumor cell may comprise a metastatic cell. In some embodiments, the cell is from a solid tissue that comprises a plurality of different cell types (e.g., different genotypes).

Samples

In some embodiments, the sample that includes the template nucleic acid, e.g. DNA and/or RNA, may be combined into the reaction mixture in an amount sufficient for producing a product. In some embodiments, the sample is combined into the reaction mixture such that the final concentration of DNA and/or RNA in the reaction mixture is from about 1 fg/µL to about 10 µg/µL, from about 1 µg/µL to about 5 µg/µL, from about 0.001 µg/µL to about 2.5 µg/µL, from about 0.005 µg/µL to about 1 µg/µL, from about 0.01 µg/µL to about 0.5 µg/τL, from about 0.1 µg/µL to about 0.25 µg/µL. In some embodiments, the sample that includes the template is isolated from a single cell. In some embodiments, the sample that includes the template is isolated from about 2, 3, 4, 5, 6, 7, 8, 9, 10, 20, 50, 100, 500 or more cells.

In some embodiments, the template is DNA, an RNA, or a combination of DNA and RNA. In some embodiments, the template is a fragment or degraded DNA, a fragment or degraded RNA, or a combination of fragment or degraded DNA and fragment or degraded RNA. In some embodiments, the total amount of template is the total amount of template in a sample. In some embodiments, the total amount of template is the total amount of template in a reaction mixture. In some embodiments, the total amount of template is the total amount of template in one pot or a single vessel. In some embodiments, the total amount of template is the total amount of template in one pot or a single vessel reaction. In some embodiments, the total amount of the template is from about 1 femtomolar (fM) to about 100 micromolar, from about 0.0001 micromolar to about 0.01 micromolar, from about 0.0001 micromolar to about 0.1 micromolar, from about 40 femtomolar to about 0.01 micromolar, from about 50 femtomolar to about 500 femtomolar, from about 50 femtomolar to about 0.01 micromolar, from about 50 femtomolar to about 0.1 micromolar, from about 50 femtomolar to about 500 picomolar, from about 50 femtomolar to about 500 nanomolar, from about 50 femtomolar to about 500 micromolar, from about 50 femtomolar to about 1 picomolar, from about 40 femtomolar to about 1 nanomolar, from about 1 femtomolar to about 1 picolomar. In some embodiments, the total amount of template is equal to or at least about or lower than about 1000 micromolar, equal to or at least about or lower than about 500 micromolar, equal to or at least about or lower than about 250 micromolar, equal to or at least about or lower than about 100 micromolar, equal to or at least about or lower than about 50 micromolar, equal to or at least about or lower than about 25 micromolar, equal to or at least about or lower than about 10 micromolar, equal to or at least about or lower than about 1 micromolar, equal to or at least about or lower than about 0.1 micromolar, equal to or at least about or lower than about 0.01 micromolar, equal to or at least about or lower than about 0.001 micromolar, equal to or at least about or lower than about 0.0001 micromolar, equal to or at least about or lower than about 2000 nanomolar, equal to or at least about or lower than about 500 nanomolar, equal to or at least about or lower than about 250 nanomolar, equal to or at least about or lower than about 200 nanomolar, equal to or at least about or lower than about 50 nanomolar, equal to or at least about or lower than about 25 nanomolar, equal to or at least about or lower than about 20 nanomolar, equal to or at least about or lower than about 2 nanomolar, equal to or at least about or lower than about 0.2 nanomolar, equal to or at least about or lower than about 0.01 nanomolar, equal to or at least about or lower than about 0.001 nanomolar, equal to or at least about or lower than about 0.0001 nanomolar, equal to or at least about or lower than about 3000 picomolar, equal to or at least about or lower than about 500 picomolar, equal to or at least about or lower than about 250 picomolar, equal to or at least about or lower than about 300 picomolar, equal to or at least about or lower than about 50 picomolar, equal to or at least about or lower than about 25 picomolar, equal to or at least about or lower than about 30 picomolar, equal to or at least about or lower than about 3 picomolar, equal to or at least about or lower than about 0.3 picomolar, equal to or at least about or lower than about 0.01 picomolar, equal to or at least about or lower than about 0.001 picomolar, equal to or at least about or lower than about 0.0001 picomolar, equal to or at least about or lower than about 5000 femtomolar, equal to or at least about or lower than about 500 femtomolar, equal to or at least about or lower than about 250 femtomolar, equal to or at least about or lower than about 50 femtomolar, equal to or at least about or lower than about 25 femtomolar, equal to or at least about or lower than about 10 femtomolar, equal to or at least about or lower than about 1 femtomolar, equal to or at least about or lower than about 0.1 femtomolar, equal to or at least about or lower than about 0.01 femtomolar, equal to or at least about or lower than about 0.001 femtomolar, equal to or at least about or lower than about 0.0001 femtomolar.

In some embodiments, the sample may be obtained from a biological sample obtained from a subject. In some embodiments, a sample comprises circulating tumor DNA sample and/or a tissue sample. In some embodiments, the biological sample comprises a cell-free biological sample. In some embodiments, the biological sample comprises a circulating tumor DNA sample. In some embodiments, the biological sample comprises a biopsy sample. In some embodiments, the biological sample comprises a tissue sample. In some embodiments, the biological sample comprises liquid biopsy. In some embodiments, the biological sample comprises cell-free DNA. In some embodiments, the biological sample can be a solid biological sample, e.g., a tumor sample. In some embodiments, a sample from a subject can comprise at least about 1%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, at least about 99%, or at least about 100% tumor cells or nucleic acid from a tumor. The solid biological sample can be processed by fixation in a formalin solution, followed by embedding in paraffin (e.g., a FFPE sample). The solid biological sample can be processed by freezing. Alternatively, the biological sample can be neither fixed nor frozen. The unfixed, unfrozen sample can be stored in a solution configured for the preservation of nucleic acid. The solid biological sample can optionally be subjected to homogenization, sonication, French press, dounce, freeze/thaw, which can be followed by centrifugation.

In some embodiments, the sample can be a liquid biological sample. In some embodiments, the liquid biological sample can be a blood sample (e.g., whole blood, plasma, or serum). A whole blood sample can be subjected to separation of cellular components (e.g., plasma, serum) and cellular components by use of a Ficoll reagent. In some embodiments, the liquid biological sample can be a urine sample. In some embodiments, the liquid biological sample can be a perilymph sample. In some embodiments, the liquid biological sample can be a fecal sample. In some embodiments, the liquid biological sample can be saliva. In some embodiments, the liquid biological sample can be semen. In some embodiments, the liquid biological sample can be amniotic fluid. In some embodiments, the liquid biological sample can be cerebrospinal fluid. In some embodiments, the liquid biological sample can be bile. In some embodiments, the liquid biological sample can be sweat. In some embodiments, the liquid biological sample can be tears. In some embodiments, the liquid biological sample can be sputum. In some embodiments, the liquid biological sample can be synovial fluid. In some embodiments, the liquid biological sample can be vomit. In some embodiments, the liquid biological sample can be a cell-free sample. In some specific embodiments, the cell-free sample can be a cell-free plasma sample.

Polynucleotides in a sample (which can be referred to as input nucleic acid or input) can comprise DNA. The input nucleic acid can be complex DNA, such as double-stranded DNA, genomic DNA or mixed nucleic acids from more than one organism. Polynucleotides in the sample can comprise RNA. The RNA can be obtained and purified. RNA can include RNAs in purified or unpurified form, which include, but are not limited to, mRNAs, tRNAs, snRNAs, rRNAs, retroviruses, small non-coding RNAs, microRNAs, polysomal RNAs, pre-mRNAs, intronic RNA, viral RNA, cell-free RNA and fragments thereof. The non-coding RNA, or ncRNA may include snoRNAs, microRNAs, siRNAs, piRNAs and long nc RNAs. Polynucleotides in the sample can comprise cDNA. The cDNA can be generated from RNA, e.g., mRNA. The cDNA can be single or double stranded. The input DNA can be mitochondrial DNA. The input DNA can be cell-free DNA The cell-free DNA can be obtained from, e.g., a serum or plasma sample. The input DNA can be from more than one individual or organism. The input DNA can be double stranded or single stranded.

In some embodiments, samples can be collected over a period of time. Samples can be collected over regular time intervals, or can be collected intermittently over irregular time intervals. Nucleic acids from different samples can be compared, e.g., to monitor progression or recurrence of a condition or disease.

In some instances, a sample can be collected by core biopsy. In some embodiments, a sample can be collected as a purified nucleic acid. Examples of such purified samples can include precipitated nucleic acid affixed to filter paper, phenol-chloroform extractions, nucleic acid purified by kit purification (e.g. Quigen Miniprep (Registered Trademark) and the like), or gel purified nucleic acid as exemplary examples.

The sample of the disclosure may be a sample from an animal (e.g., human, rat, pig, horse, cow, dog, mouse). In some instances, the sample is a human sample. The sample may be a fetal human sample. The sample may be from a multicellular tissue (e.g., an organ (e.g., brain, liver, lung, kidney, prostate, ovary, spleen, lymph node, thyroid, pancreas, heart, skeletal muscle, intestine, larynx, esophagus, and stomach), a blastocyst). The sample may be a cell from a cell culture.

The sample may comprise a plurality of cells. The sample may comprise a plurality of the same type of cell. The sample may comprise a plurality of different types of cells. The sample may comprise a plurality of cells at the same point in the cell cycle and/or differentiation pathway. The sample may comprise a plurality of cells at different points in the cell cycle and/or differentiation pathway. A sample may comprise a plurality of samples.

The plurality of samples may comprise at least 5, 10, 20, 30, 40, 50, 60, 70, 80, 90 or 100 or more samples. The plurality of samples may comprise at least about 100, 200, 300, 400, 500, 600, 700, 800, 900 or 1000 or more samples. The plurality of samples may comprise at least about 1000, 2000, 3000, 4000, 5000, 6000, 7000, 8000 samples, 9000, or 10,000 samples, or 100,000 samples, or 1,000,000 or more samples. The plurality of samples may comprise at least about 10,000 samples.

The one or more nucleic acids in the first sample may be different from one or more nucleic acids in the second sample. The one or more nucleic acids in the first sample may be different from one or more nucleic acids in a plurality of samples. The one or more nucleic acids may comprise a length of at least about 1 nucleotide, 2 nucleotides, 5 nucleotides, 10 nucleotides, 20 nucleotides, 50 nucleotides, 100 nucleotides, 200 nucleotides, 300 nucleotides, 500 nucleotides, 1000 nucleotides, 2000 nucleotides, 3000 nucleotides, 4000 nucleotides, 5000 nucleotides, 10,000 nucleotides, 100,000 nucleotides, 1,000,000 nucleotides.

The first sample may comprise one or more cells and the second sample may comprise one or more cells. The one or more cells of the first sample may be of the same cell type as the one or more cells of the second sample. The one or more cells of the first sample may be of a different cell type as one or more different cells of the plurality of samples. The cell type may be chondrocyte, osteoclast, adipocyte, myoblast, stem cell, endothelial cell or smooth muscle cell. The cell type may be an immune cell type. The immune cell type may be a T cell, B cell, thrombocyte, dendritic cell, neutrophil, macrophage or monocyte.

The plurality of samples may comprise one or more malignant cell. The one or more malignant cells may be derived from a tumor, sarcoma or leukemia.

The plurality of samples may comprise at least one bodily fluid. The bodily fluid may comprise blood, urine, lymphatic fluid, saliva. The plurality of samples may comprise at least one blood sample.

The plurality of samples may comprise at least one cell from one or more biological tissues. The one or more biological tissues may be a bone, heart, thymus, artery, blood vessel, lung, muscle, stomach, intestine, liver, pancreas, spleen, kidney, gall bladder, thyroid gland, adrenal gland, mammary gland, ovary, prostate gland, testicle, skin, adipose, eye or brain.

The biological tissue may comprise an infected tissue, diseased tissue, malignant tissue, calcified tissue or healthy tissue.

The plurality of samples may be from one or more sources. The plurality of samples may be from two or more sources. The plurality of samples may be from one or more subjects. The plurality of samples may be from two or more subjects. The plurality of samples may be from the same subject. The one or more subjects may be from the same species. The one or more subjects may be from different species. The one or more subjects may be healthy. The one or more subjects may be affected by a disease, disorder or condition. The plurality of samples may comprise cells of an origin selected from a mammal, bacteria, virus, fungus or plant. The one or more samples may be from a human, horse, cow, chicken, pig, rat, mouse, monkey, rabbit, guinea pig, sheep, goat, dog, cat, bird, fish, frog and fruit fly.

In some embodiments, the plurality of samples may be obtained concurrently. The plurality of samples may be obtained at the same time. The plurality of samples may be obtained sequentially. The plurality of samples may be obtained over a course of years, 100 years, 10 years, 5 years, 4 years, 3 years, 2 years or 1 year of obtaining one or more different samples. One or more samples may be obtained within about one year of obtaining one or more different samples. One or more samples may be obtained within 12 months, 11 months, 10 months, 9 months, 8 months, 7 months, 6 months, 4 months, 3 months, 2 months or 1 month of obtaining one or more different samples. One or more samples may be obtained within 30 days, 28 days, 26 days, 24 days, 21 days, 20 days, 18 days, 17 days, 16 days, 15 days, 14 days, 13 days, 12 days, 1 days, 10 days, 9 days, 8 days, 7 days, 6 days, 5 days, 4 days, 3 days, 2 days or one day of obtaining one or more different samples. One or more samples may be obtained within about 24 hours, 22 hours, 20 hours, 18 hours, 16 hours, 14 hours, 12 hours, 10 hours, 8 hours, 6 hours, 4 hours, 2 hours or 1 hour of obtaining one or more different samples. One or more samples may be obtained within about 60 sec, 45 sec, 30 sec, 20 sec, 10 sec, 5 sec, 2 sec or 1 sec of obtaining one or more different samples. One or more samples may be obtained within less than one second of obtaining one or more different samples.

In some embodiments, the present disclosure provides methods, kits and compositions for diagnosing, monitoring, and/or prognosing a status or outcome of a disease or condition in a subject. Generally, the method comprises (a) labeling one or more molecules (e.g., fragmented or degraded nucleic acid, DNA or RNA) from one or more samples to produce one or more labeled nucleic acids; (b) amplifying the one or more labeled nucleic acids (c) detecting and/or quantifying the one or more labeled nucleic acids; and (d) diagnosing, monitoring, and/or prognosing a status or outcome of a disease or condition in a subject based on the detecting and/or quantifying of the one or more labeled nucleic acids. In some embodiments, the one or more labeled nucleic acid is indicative of a disease, e.g. cancer. In some embodiments, the one or more labeled nucleic acid is present in a femtomolar range. The method may further comprise determining a therapeutic regimen. The one or more of samples may comprise one or more samples from a subject suffering from a disease or condition. The one or more samples may comprise one or more samples from a healthy subject. The one or more samples may comprise one or more samples from a control.

Monitoring a disease or condition may further comprise monitoring a therapeutic regimen. Monitoring a therapeutic regimen may comprise determining the efficacy of a therapeutic regimen. In some instances, monitoring a therapeutic regimen comprises administrating, terminating, adding, or altering a therapeutic regimen. Altering a therapeutic regimen may comprise increasing or reducing the dosage, dosing frequency, or mode of administration of a therapeutic regimen. A therapeutic regimen may comprise one or more therapeutic drugs. The therapeutic drugs may be an anticancer drug, antiviral drug, antibacterial drug, antipathogenic drug, or any combination thereof. In some embodiments, amplification of a target sequence can comprise at least a part of a genome of an organism. In some embodiments, at least about 0.01%, about 0.02%, about 0.03%, about 0.04%, about 0.05%, about 0.06%, about 0.07%, about 0.08%, about 0.09%, about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 55%, about 60%, about 65%, about 70%, about 75%, about 80%, about 85%, about 90%, about 95%, about 96%, about 97%, about 98%, about 99%, or about 100% of the genome of an organism can be amplified and/or analyzed.

In some embodiments, amplification of a target sequence can comprise at least a part of a transcriptome of an organism. In some embodiments, at least about 0.01%, about 0.02%, about 0.03%, about 0.04%, about 0.05%, about 0.06%, about 0.07%, about 0.08%, about 0.09%, about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, about 20%, about 21%, about 22%, about 23%, about 24%, about 25%, about 26%, about 27%, about 28%, about 29%, about 30%, about 31%, about 32%, about 33%, about 34%, about 35%, about 36%, about 37%, about 38%, about 39%, about 40%, about 41%, about 42%, about 43%, about 44%, about 45%, about 46%, about 47%, about 48%, about 49%, about 50%, about 55%, about 60%, about 65%, about 70%, about 75%, about 80%, about 85%, about 90%, about 95%, about 96%, about 97%, about 98%, about 99%, or about 100% of a transcriptome of an organism can be amplified and analyzed.

In some embodiments, the characteristic that improves enzyme property is selected from the group consisting of increased stability (e.g., increased thermostability), increased specific activity, increased protein expression, increased processivity, increased strand displacement, increased end-to-end template jumping, and increased fidelity.

EXAMPLES

The following specific examples are illustrative and non-limiting. The examples described herein reference and provide non-limiting support to the various embodiments described in the preceding sections.

Example 1: Expression and Purification

Small and medium scale: Expression vector pET-45b caring modified R2 non-long terminal repeat (LTR) retrotransposon or a modified R2 reverse transcriptase was transformed into *E. coli* BL21 (DE3). TABLE 3 below shows two examples of modified R2 enzyme variants of the present disclosure, P2 and P8 variants. For expression, pre-culture was setup in 2 ml LB with 100 μM Corbenicillin and grown overnight for about 8 to 12 hours at room temperature. After about 8 to 12 h, 200 μL of the pre-culture was transferred to 25 mL of an auto-induction expression media, Overnight Express TB (Novagen), and shaker-incubated at room temperature for 36 hours to 48 hours. Cells were harvested by centrifugation at 8000×g for 10 min at 4-8° C. The biomass-pellet was frozen at −20° C. for a minimum of 1 h.

TABLE 3

| | | |
|---|---|---|
| P2 variant R2 enzyme | pET45b(+)-R2-N-terminal truncation | MetAHHHHHHVGTVGTGGGSGGASTALKTAGRRNDLHDDRTAS AHKTSRQKRRAEYARVQELYKKCRSRAAAEVIDGACGGVGHSL EEMetETYWRPILERVSDAPGPTPEALHALGRAEWHGGNRDYTQL WKPISVEEIKASRFDWRTSPGPDGIRSGQWRAVPVHLKAEMetFN AWMetARGEIPEILRQCRTVFVPKVERPGGPGEYRPISIASIPLRHFH SILARRLLACCPPDARQRGFICADGTLENSAVLDAVLGDSRKKLR ECHVAVLDFAKAFDTVSHEALVELLRLRGMetPEQFCGYIAHLYD TASTTLAVNNEMetSSPVKVGRGVRQGDPLSPILFNVVMetDLILAS LPERVGYRLEMetELVSALAYADDLVLLAGSKVGMetQESISAVDC VGRQMetGLRLNCRKSAVLSMetIPDGHRKKHHYLTERTFNIGGKP LRQVSCVERWRYLGVDFEASGCVTLEHSISSALNNISRAPLKPQQ RLEILRAHLIPRFQHGFVLGNISDDRLRMetLDVQIRKAVGQWLRL PADVPKAYYHAAVQDGGLAIPSVRATIPDLIVRRFGGLDSSPWSV ARAAAKSDKIRKKLRWAWKQLRRFSRVDSTTQRPSVRLFWREHL HASVDGRELRESTRTPTSTKWIRERCAQITGRDFVQFVHTHINALP SRIRGSRGRRGGGESSLTCRAGCKVRETTAHILQQCHRTHGGRIL RHNKIVSFVAKAMetEENKWTVELEPRLRTSVGLRKPDIIASRDGV GVIVDVQVVSGQRSLDELHREKRNKYGNHGELVELVAGRLGLPK AECVRATSCTISWRGVWSLTSYKELRSIIGLREPTLQIVPILALRGS HMetNWTRFNQMetTSVMetGGGVGStop |
| P8 variant R2 enzyme | pET45b(+)-N-terminal truncation R2 KPA (endonuclease mutation) | MetAHHHHHHVGTVGTGGGSGGASTALKTAGRRNDLHDDRTAS AHKTSRQKRRAEYARVQELYKKCRSRAAAEVIDGACGGVGHSL EEMetETYWRPILERVSDAPGPTPEALHALGRAEWHGGNRDYTQL WKPISVEEIKASRFDWRTSPGPDGIRSGQWRAVPVHLKAEMetFN AWMetARGEIPEILRQCRTVFVPKVERPGGPGEYRPISIASIPLRHFH SILARRLLACCPPDARQRGFICADGTLENSAVLDAVLGDSRKKLR ECHVAVLDFAKAFDTVSHEALVELLRLRGMetPEQFCGYIAHLYD TASTTLAVNNEMetSSPVKVGRGVRQGDPLSPILFNVVMetDLILAS LPERVGYRLEMetELVSALAYADDLVLLAGSKVGMetQESISAVDC VGRQMetGLRLNCRKSAVLSMetIPDGHRKKHHYLTERTFNIGGKP LRQVSCVERWRYLGVDFEASGCVTLEHSISSALNNISRAPLKPQQ RLEILRAHLIPRFQHGFVLGNISDDRLRMetLDVQIRKAVGQWLRL PADVPKAYYHAAVQDGGLAIPSVRATIPDLIVRRFGGLDSSPWSV |

TABLE 3-continued

```
ARAAAKSDKIRKKLRWAWKQLRRFSRVDSTTQRPSVRLFWREHL
HASVDGRELRESTRTPTSTKWIRERCAQITGRDFVQFVHTHINALP
SRIRGSRGRRGGGESSLTCRAGCKVRETTAHILQQCHRTHGGRIL
RHNKIVSFVAKAMetEENKWTVELEPRLRTSVGLRKPAIIASRDGV
GVIVDVQVVSGQRSLDELHREKRNKYGNHGELVELVAGRLGLPK
AECVRATSCTISWRGVWSLTSYKELRSIIGLREPTLQIVPILALRGS
HMetNWTRFNQMetTSVMetGGGVGStop
```

Purification: pellet was re-suspended in 0.5 mL lysis buffer (0.5 mL lysis buffer per ⅙ of the biomass) and incubated for 30 minutes at room temperature. Lysis buffer composition: 1× BugBuster, 100 mM Sodium Phosphate, 0.1% Tween, 2.5 mM TCEP, 3 μL Protease inhibitor mix (Roche), 50 μg lysozyme, 0.5 μL DNaseI (2,000 units/ml, from NEB). After incubation, the lysate was mixed with equal volume (0.5 mL) of His-binding buffer (50 mM Sodium Phosphate pH 7.7, 1.5M Sodium Chloride, 2.5 mM TCEP, 0.1% Tween, 0.03% Triton X-100, and 10 mM Imidazole) and incubated at room temperature for about 10-15 minutes. After incubation, the lysate was centrifuged at 10000×g for about 15 min at a temperature from about 4° C. to about 8° C. Pellet was then mixed with 250 μL of His-Affinity Gel (His-Spin Protein Miniprep by Zymo Research) according to manufacturer's protocol. After the binding step, the His-Affinity Gel was washed three times with Washing buffer (50 mM Sodium Phosphate pH 7.7, 750 mM Sodium Chloride, 0.1% Tween, 0.03% Triton X-100, 2.5 mM TCEP, and 50 mM Imidazole). The R2 reverse transcriptase (RT) (e.g. modified enzyme) was eluted with 150 μL of elution buffer (50 mM Sodium Phosphate pH 7.7, 300 mM Sodium Chloride, 2.5 mM TCEP, 0.1% Tween, and 250 mM Imidazole) and either used directly or frozen in 30% glycerol. This protocol can be adjusted for expression and purification of mutagenesis and for screening. For example, a similar protocol can be adjusted to a plate format, such as 2 mL of the Overnight Express TB (Novagen) instead of 25 mL can be used, and the purification step can comprise 96 well spin plates with nickel-immobilized resin.

Figure 10:
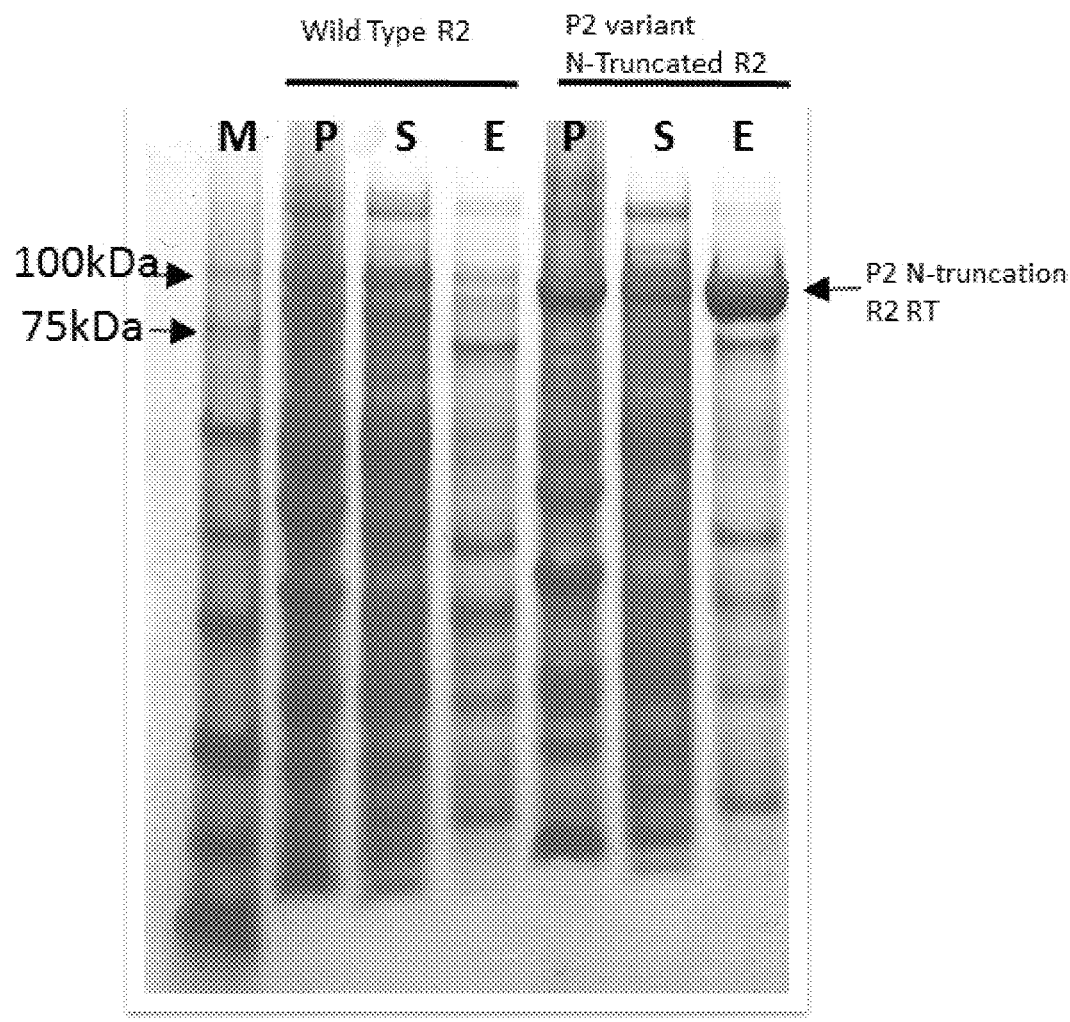
FIG. 10 illustrates a gel showing purified wild type R2 reverse transcriptase and N-terminal truncated R2 reverse transcriptase.

Result: After purification, samples were analyzed using sodium dodecyl sulfate polyacrylamide gel electrophoresis (SDS-PAGE), 4-12% polyacrylamide, Bis-Tris (FIG. 10). SDS-PAGE analysis in FIG. 10 illustrates samples containing a full length wild type R2 and truncated R2 non-LTR retrotransposon. The results showed that no clear product for the full length wild type R2 was observed, while there was a significant expression level for the truncated R2 non-LTR retrotransposon. The eluted sample showed high yield of the truncated R2 non-LTR retrotransposon that was His-tag affinity purified with IMAC. FIG. 10 lanes are as follow: M indicates a marker, P indicates a pellet (insoluble), S indicates a supernatant (soluble), and E indicates eluted samples (His-tag affinity purified R2).

Example 2: Surrogate/Diagnostic Assays

Example of reverse transcriptase (RT) activity assay: Assay can be used to compare enzyme activity, active fraction, stability (e.g., thermostability), and robustness of the mutants (e.g., modified enzymes). RT activity and active fraction(s) were estimated based on primer extension assay by comparing fraction(s) of extended to non-extended DNA primer using various template/primer and enzyme concentrations. Extension assay was conducted with and without the addition of a DNA trap. Example protocol: annealed 0.2 μM template/primer with fluorescently labeled primer was pre-incubated with various concentrations of R2 RT (relative to template/primer 0.1 to 4-fold) at room temperature for 20 minutes. Pre-incubation conditions included 40 mM Tris pH 7.5, 200 mM NaCl, 5 mM TCEP, and 0.1% Tween. Extension started with the addition of $MgCl_2$ (5 mM, final) and dNTPs (25 μM of each, final) and optionally a DNA trap (unlabeled DNA oligo duplex at 3 μM, final, or heparin). The addition of trap DNA helps to estimate RT active fraction(s). The reaction was then incubated for 10 minutes and stopped with EDTA (50 mM, final) or formamide (50%, final). The product of the reaction was analyzed with 15% PAGE-Urea. An example of a template sequence used is rCrArG rUrCrA rGrUrC rArGrU rCrArG rUrCrA rGrUrG rCrCrA rArArU rGrCrC rUrCrG rUrCrA rUrC and of a primer is/56-FAM/ TGATGACGAGGCATTTGGC.

Example of end-to-end template jumping assay: Primer extension assay with two templates where one template is annealed to a fluorescently labeled primer (donor template) and the other is primer-free (acceptor nucleic acid). Example protocol: annealed 0.1 μM template/primer with fluorescently labeled primer (alternatively the product of the reaction can be stained with Syber Gold) was pre-incubated with various concentrations of R2 RT (relative to template/primer 0.1 to 4-fold) at room temperature for 20 minutes. Pre-incubation conditions included 40 mM Tris pH 7.5, 200 mM NaCl, 5 mM TCEP, and 0.1% Tween. Extension started with the addition of $MgCl_2$ (5 mM, final), dNTPs (50 μM of each, final) and the acceptor nucleic acid at various concentrations (range from about 0.01 μM to about 5 μM). The reaction was then incubated for 30 min-h and stopped with EDTA (50 mM, final) or formamide (50%, final). The product of the reaction was analyzed with 15% PAGE-Urea. Templates: the templates were generated by in vitro RNA synthesis with 17 RNA polymerase based on the DNA template generated in a PCR reaction with two primers, one of which included a T7 promoter sequence (i.e., a first primer). The second primer was also used as a DNA primer in the donor template/primer protocol. The product of the reaction was then analyzed with 15% PAGE-Urea. Example of materials used: template for PCR amplification pUC18 with T7 primer CTGCAGTAATACGACTCACTATAG-GATCCTCTAGAGTCGACCTGC; donor primer GCCAT-TCGCCATTCAGGCTGC (used for both PCR amplification and priming at the donor RNA template); RNA template (~190 nucleotides); acceptor nucleic acid—G-block PCR template ACGGCCAGTGAATTGTAATACGACTCAC-TATAGGGCGAATTGGGTACCGCCTCGAGGTCGACG GTATCGATAAGCTTGATATCGAATTCCTGCAGCG-GATCCACTAGTTCTAGAGCGGCCGCCACCG CGGTGGAGCTCCAGCTTTTGTTCCCTTTAGT-GAGGGTTAATTCGAGCTTGGCGTAATCATGGTC ATAGCTGTTTCC; two primers for PCR amplification (a T7 primer ACGGCCAGTGAATTGTAATACGAC and a second primer GGAAACAGCTATGACCATG).

Example of processivity assay: processivity assay was analyzed based on primer extension and product formation using a 15% PAGE-Urea, or a 1.2% agarose gel, or a 2% agarose gel. Product length distribution was analyzed with densitometry. Example protocol: annealed 0.05-0.1 µM template/primer with fluorescently labeled primer (alternatively product of the reaction can be stained with Syber Gold) was pr-incubated with various concentration of R2 RT (0.1 to µl/µl) or MMLV (2 U/µl), and $H_2$. The reactions containing the R2 enzyme or the R2 buffer were incubated at 30° C. for 1 hour (lanes 2-5). The reaction containing the MMLV enzyme was incubated at 42° C. for 1 hour (lane 6). Products were analyzed using 15% PAGE-Urea gel.

TABLE 4

| Reaction | Lane 2 | Lane 3 | Lane 4 | Lane 5 | Lane 6 |
|---|---|---|---|---|---|
| $H_2O$ | 36.5 µl | 33 µl | 32.75 µl | 36.25 µl | 34 µl |
| 5X R2 buffer | 10 µl | 10 µl | 10 µl | 10 µl | 0 µl |
| 5X MMLV buffer | 0 µl | 0 µl | 0 µl | 0 µl | 10 µl |
| 10 mM dNTPs | 1.25 µl | 1.25 µl | 1.25 µl | 1.25 µl | 1.25 µl |
| 10 µM template/primer (P173 + P174) | 2 µl | 2 µl | 2 µl | 2 µl | 2 µl |
| 100 µM P181 TSO (acceptor nucleic acid) | 0.25 µl | 0 µl | 0.25 µl | 0.5 µl | 0.25 µl |
| 0.3 µg/µl P8 (R2 enzyme) | 0 µl | 3.75 µl | 3.75 µl | 3.75 µl | 0 µl |
| 40 unit/µl MMLV-RT (Clontech) | 0 µl | 0 µl | 0 µl | 0 µl | 2.5 µl |
| Total | 50 µl | 50 µl | 50 µl | 50 µl | 50 µl |

4-fold relative to template/primer) for 20 minutes at room temperature. Pre-incubation conditions: 40 mM Tris pH 7.5, 200 mM NaCl, 5 mM TCEP, and 0.1% Tween. Extension started with addition of $MgCl_2$ (5 mM, final), dNTPs (50 µM of each, final), and optionally a DNA trap (unlabeled DNA oligo duplex at 3 µM, final). The reaction was then incubated for 30 min-1 h and stopped with EDTA (50 mM, final) or formamide (50%, final). Templates: the templates were generated by in vitro RNA synthesis with T7 RNA polymerase based on the DNA template generated in a PCR reaction with two primers, one of which included a T7 promoter sequence. The second primer was also used as a DNA primer in the donor template/primer protocol. The product of the reaction was analyzed with a 15% PAGE-Urea, or a 1.2% agarose gel, or a 2% agarose gel. Materials included: template for PCR amplification pUC18 with T7 primer CTGCAGTAATACGACTCACTATAG-GATCCTCTAGAGTCGACCTGC, RT primer CAGGGTT-ATTGTCTCATGAGCG (used for both PCR amplification and priming at the donor RNA template), and RNA template (~600 nucleotides).

Example of Random priming: Longer RNA template(s) with several primers with adapters or random primers with adapters; product analysis is performed after PCR amplification to compare product's length distribution (one primer is specific to the 5'-end of the template and the second primer is complementary to the adapter sequence).

Example 3: Activity and Template Jumping Experiment Using Synthetic RNA

Figure 11:
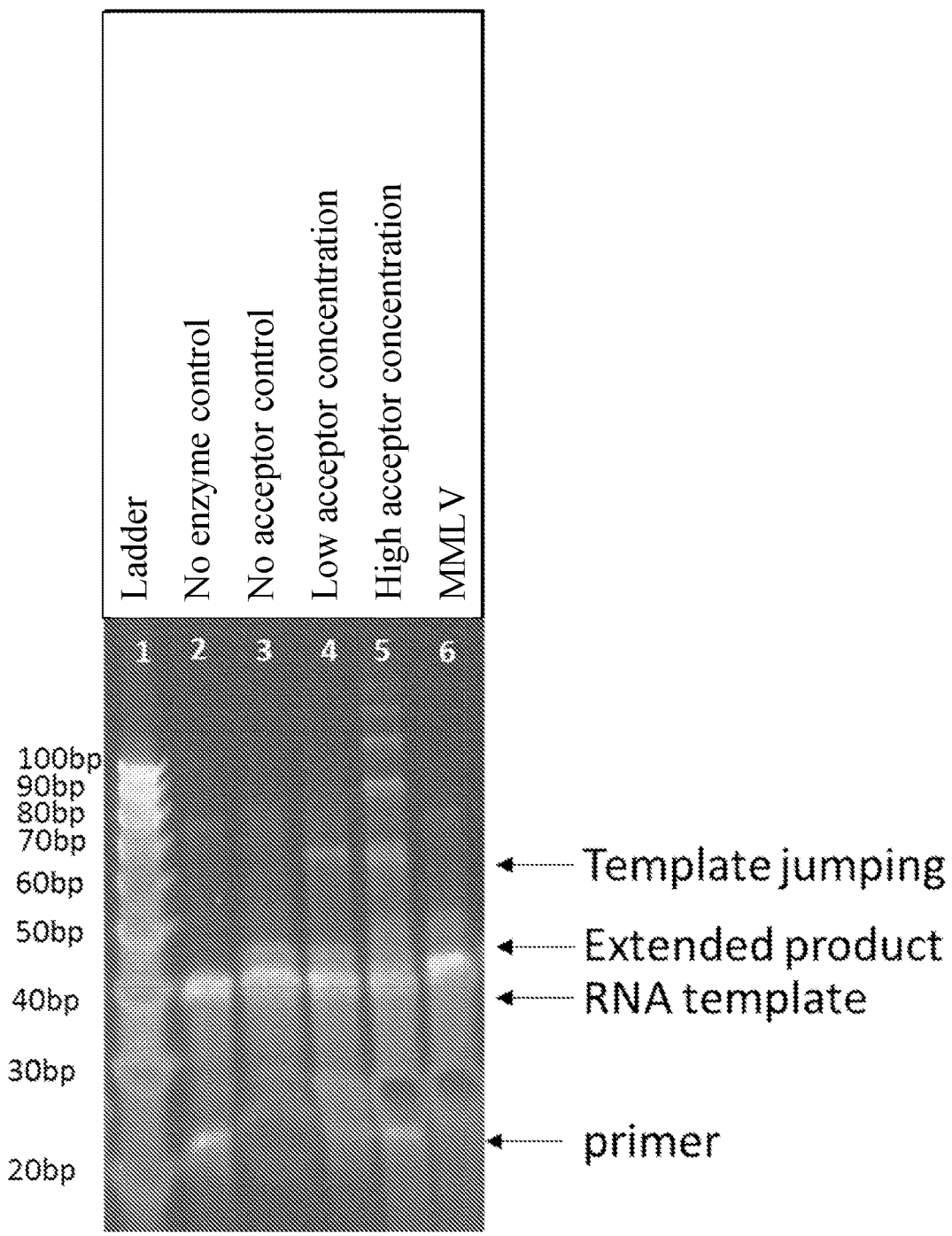
FIG. 11 illustrates a polyacrylamide gel electrophoresis (PAGE) gel showing activity and template jumping properties of an R2 enzyme and of moloney munne leukemia virus (MMLV) reverse transcriptase by using synthetic RNA.

Modified R2 enzyme showed activity and template jumping properties (FIG. 11). Experiment described in TABLE 4 below, and represented by FIG. 11, showed that there was no activity when the reaction lacked an enzyme (lane 2), that there was extension product but no template jumping when the reaction lacked an acceptor nucleic acid (lane 3), and that template jumping was dependent on the concentration of the acceptor nucleic acid (lanes 4 and 5). Lane 6 shows that although the enzyme MMLV is capable of product extension, no apparent product was observed (TABLE and FIG. 11). In brief, the reactions contained 0.25 mM of dNTPs, R2 buffer or MMLV buffer, 0.4 µM template/primer, acceptor nucleic acid (0 to 1 µM), modified R2 enzyme (0 to 0.023

Sequences:

```
P173 (RNA template)
CAGUCAGUCAGUCAGUCAGUGCCAAAUGCCUCGUCAUC

P174 (fluorescently labeled primer)
/56-FAM/TGATGACGAGGCATTTGGC

P181 (acceptor nucleic acid)
GTTAATAACGAAATGAGCAGCCrGrGrG
```

Example 4: 1-Pot (Single Vessel Reaction)

Figure 12A:
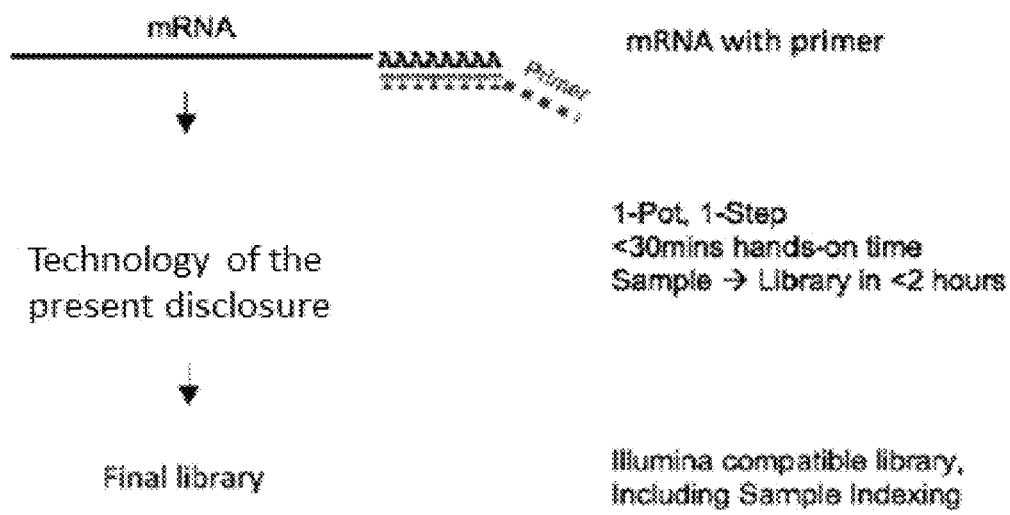
FIG. 12A illustrates a workflow for sequencing library preparation.
Figure 12B:
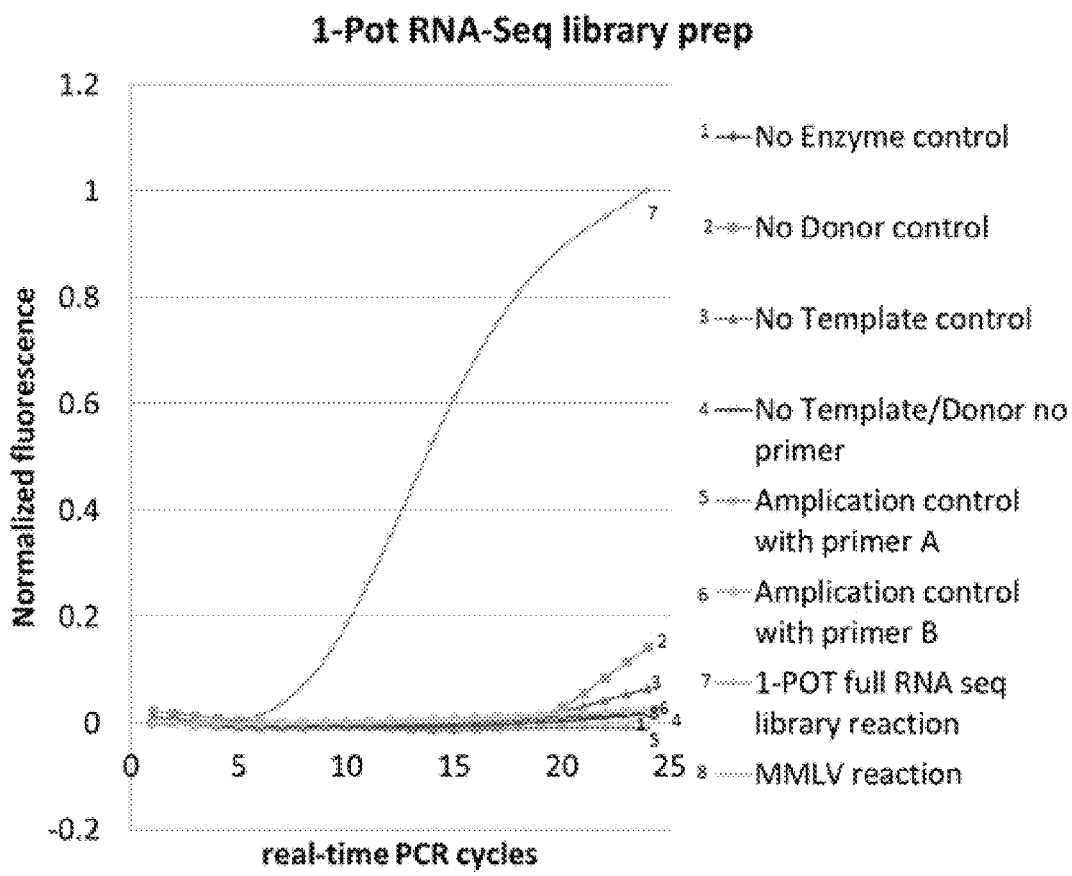
FIG. 12B illustrates real-time PCR data of library preparation based on 1-pot (e.g., single vessel) reactions.

This experiment was designed to demonstrate a method for preparing 1-pot (single vessel) RNA library (TABLE 5). This experiment successfully captured a 200 bp RNA molecule in 1-pot (single vessel) reaction. A schematic of the workflow is shown in FIG. 3 and FIG. 12A. The template used in this experiment was a 200 base pair synthetic RNA (donor template) generated using T7 in vitro transcription protocol. The controls included: no enzyme control, no acceptor control, no acceptor and no donor template with primer control, and MMLV (TABLE 5). Other controls used in this experiment included using only one primer during PCR amplification (FIG. 12B, numbers 5 and 6).

Figure 12C:
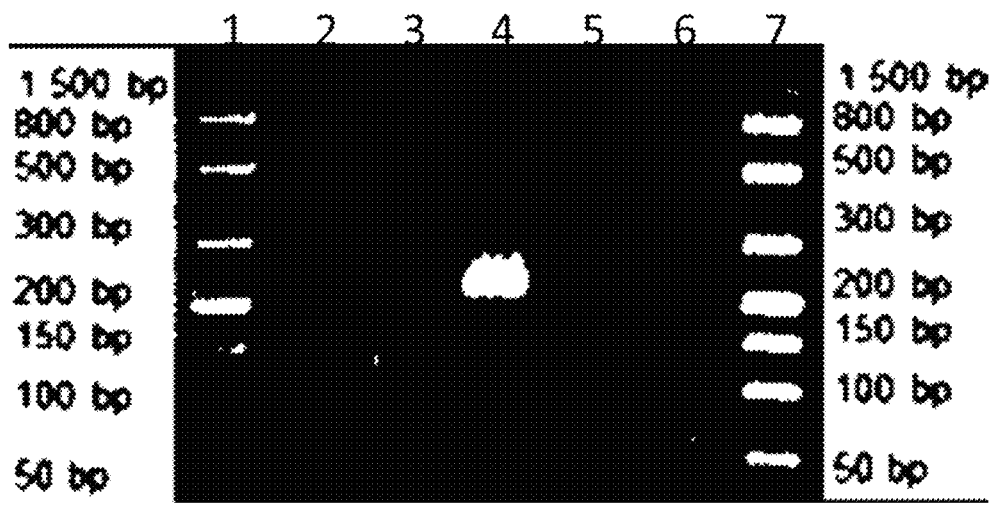
FIG. 12C illustrates a gel showing amplicon.

In brief, the R2 enzyme reaction (RT reaction) included $H_2O$, R2 buffer, 0.25 mM of dNTPs, 0.025 µM 200 bpRNA/primer (donor template with primer), acceptor nucleic acid (0.15 µM), and 0.023 µg/µl of R2 enzyme (e.g., modified reverse transcriptase enzyme) (TABLE 5. FIG. 12C lane 4). Refer to TABLE 5 for the specifics of the other reactions. The R2 reaction was then incubated at 30° C. for 1 hour and the MMLV reaction was incubated at 42° C. for 1 hour. The reactions were then supplemented with PCR reagents including amplification primers and a hot-start polymerase (TABLE 6). In brief, 2.5 µl of the RT reaction (i.e., 2.5 µl of the 50 µl reaction from TABLE 5) was supplemented with components necessary for PCR amplication. The PCR amplification reaction for R2 enzyme included $H_2O$, SYBR FAST master mix, 0.5 µM each of P186 primer and P170 primer, and template (e.g., 2.5 µl of the RT reaction). The PCR condition was 95° C. for 3 minutes and 30 cycles of 95° C. for 3 seconds and 62° C. for 20 seconds. The reactions were then increased to 68° C. No purification step was needed during this experiment (e.g., the RT reaction was not purified prior to PCR). In some instances, the initial RT reaction (or R2 reaction) was diluted 10 fold during the PCR step. e.g., 2.5 µl RT reaction in 25 µl total volume (see, TABLE 6). In some instances, 10 µl RT reaction and 90 µl PCR reagents can be added to the same tube (hence a 1-pot or single vessel reaction). The gel in FIG. 12B shows that the right size amplicon was generated using the R2 enzyme reaction (lane 4). The other lanes did not show amplicon formation (lane 1: ladder; lane 2: no enzyme control, lane 3: MMLV control; lane 5: no acceptor control; lane 6: no donor control; and lane 7 ladder).

```
                                                -continued
AGCUGGCGUAAUAGCGAAGAGGCCCGCACCGAUCGCCCUUC

CCAACAGUUGCGCAGCCUGAAUGGCGAAUGGC

P186 (amplification primer)
CAGTCAGTCAGTCAGTCAGTGCCA

P187 (primer)
CACGACGTTGTAAAACGACGGC

P170 (amplification primer)
GCCATTCGCCATTCAGGCTGC
```

TABLE 5

| Reaction | No Enzyme control | No donor control | No acceptor control | No acceptor control/no donor template with primer | R2 enzyme | MMLV |
|---|---|---|---|---|---|---|
| H₂O | 32.5 µl | 30 µl | 33.75 µl | 34.375 µl | 28.75 µl | 36.75 µl |
| 5X R2 buffer | 10 µl | 10 µl | 10 µl | 10 µl | 10 µl | 0 µl |
| 5X MMLV buffer | 0 µl | 0 µl | 0 µl | 0 µl | 0 µl | 10 µl |
| 10 mM dNTPs | 1.25 µl | 1.25 µl | 1.25 µl | 1.25 µl | 1.25 µl | 1.25 µl |
| 12 µM 200bpRNA (donor template without primer) | 0 µl | 0 µl | 0 µl | 0.625 µl | 0 µl | 0 µl |
| 1 µM 200bpRNA/primer (RNA + P187) (donor template with primer) | 1.25 µl | 0 µl | 1.25 µl | 0 µl | 1.25 µl | 1.25 µl |
| 1 µM P173 | 5 µl | 5 µl | 0 µl | 0 µl | 5 µl | 0 µl |
| 0.3 µg/µl P2 (R2 enzyme) | 0 µl | 3.75 µl | 3.75 µl | 3.75 µl | 3.75 µl | 0 µl |
| 40 unit/µl MMLV-RT (Clontech) | 0 µl | 0 µl | 0 µl | 0 µl | 0 µl | 1.25 µl |
| Total | 50 µl | 50 µl | 50 µl | 50 µl | 50 µl | 50 µl |

TABLE 6

| Reagents | volume |
|---|---|
| H₂O | 7.5 µl |
| 2X SYBRFAST master mix | 12.5 µl |
| 10 µM primer (P186) | 1.25 µl |
| 10 µM primer (P170) | 1.25 µl |
| 10X template (or RT reaction) | 2.5 µl |
| Total | 25 µl |

Thermocycling

| | | |
|---|---|---|
| 95° C. | 3 minutes | |
| 95° C. | 3 seconds | |
| 62° C. | 20 seconds | 30 cycles |
| 68° C. | 5' | |

```
P173 (RNA template)
CAGUCAGUCAGUCAGUCAGUGCCAAAUGCCUCGUCAUC 200 bp RNA
GGAUCCUCUAGAGUCGACCUGCAGGCAUGCAAGCUUGGCAC

UGGCCGUCGUUUUCAACGUCGUGACUGGGAAAACCCUGGCG

UUACCCAACUUAAUCGCCUUGCAGCACAUCCCCCUUUCGCC
```

Figure 13:
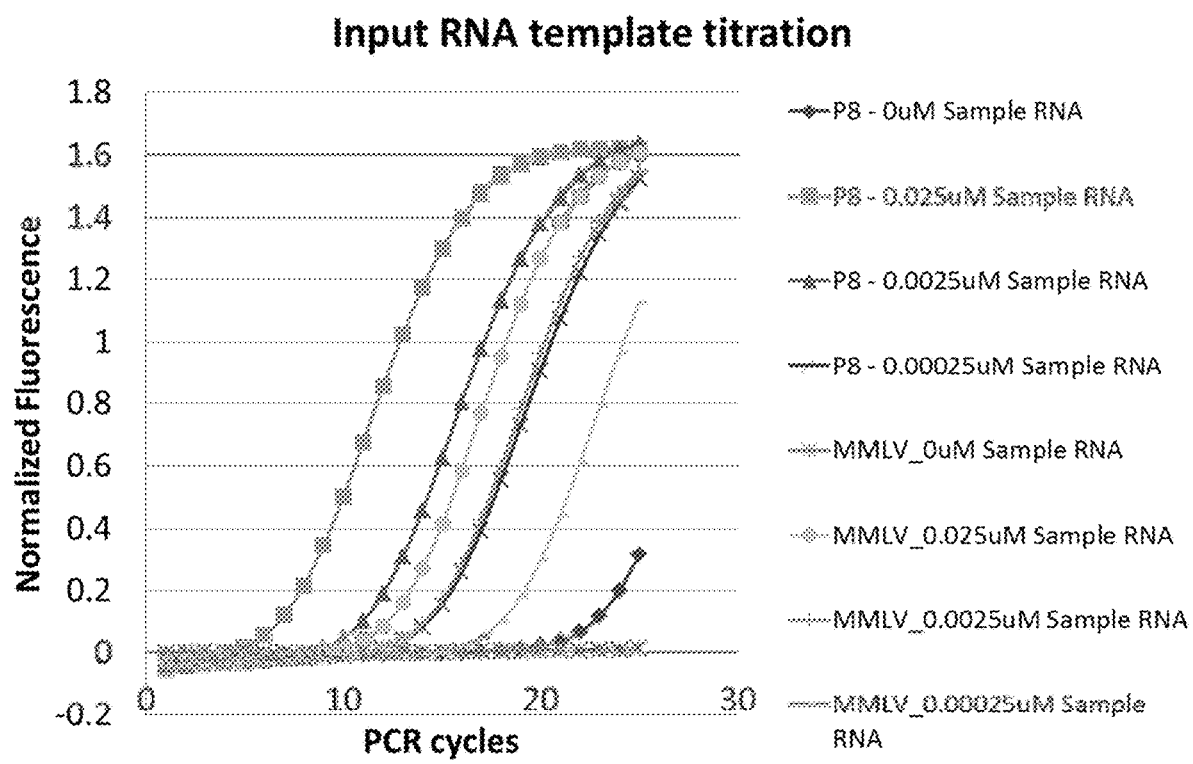
FIG. 13 illustrates 1-pot (e.g., single vessel) RNA library preparation using different template amounts.

Example 5: 1-Dot (Single Vessel) RNA Library Prep Using Various Template Amounts This experiment was designed to demonstrate a method for preparing 1-pot (single vessel) RNA library using different amounts of template RNA (TABLE 7). A schematic of the workflow is shown in FIG. 3. The template used in this experiment was a 600 base pair synthetic RNA (donor template). The RNA template amounts used in this experiment varied from 0 µM, 0.00025 µM, 0.0025 µM, and 0.025 µM. In brief, the reactions included H₂O, R2 buffer or MMLV buffer, 0.25 mM dNTPs, 600 bp RNA template with primer (0 µM, 0.00025 µM, 0.0025 µM and 0.025 µM), acceptor nucleic acid molecule (6 µM of P181 TSO for MMLV reactions) or 0.1 µM of P173 for R2 reactions, and enzyme (0.023 µg/µl of modified R2 enzyme or 0.4 U/µl of MMLV). The R2 reactions were incubated at 30° C. for 1 hour (TABLE 7, numbers 1-4) and the MMLV reactions were incubated at 42° C. for 1 hour (TABLE 7, numbers 5-8). The reactions were then supplemented with PCR reagents including amplification primers and hot-start polymerase. The PCR conditions are shown in TABLE 8 for the R2 reactions (reactions 1-4) and in TABLE 9 for the MMLV reactions (reactions 5-8). The R2 reactions included H₂O, SYBR FAST master mix, 0.5 µM each of P186 primer and P172 primer, and 1× template (2.5 µl of the RT reaction). The MMLV reactions included H₂O, SYBR FAST master mix, 0.5 µM each of P161 primer and P172 primer, and 1× template (2.5 µl of the RT reaction). In brief, 2.5 µl of the RT reaction (e.g., without cleanup) was incubated with PCR components including SYBRFAST master mix, primers, and H2O in a total volume of 25 µl (one pot/tube/single vessel reaction). The PCR conditions for the R2 reactions were 95° C. for 3 minutes and 30 cycles of 95° C. for 3 seconds, 54° C. for 10 seconds, and 64° C. for 20 seconds. The reactions were then increased to 68° C. The PCR conditions for the MMLV reactions were 95° C. for 3 minutes and 30 cycles of 95° C. for 3 seconds and 64° C. for 20 seconds. The reactions were then increased to 68° C. No purification step was needed during the course of this experiment. In some instances, the initial reaction can be diluted 10-fold during PCR by adding 10 µl RT reaction and 90 µl PCR reagents to the same tube, making it a 1-pot (single vessel) reaction. The results using real-time PCR showed product conversion at various amounts of 600 base pair RNA and showed that the R2 enzyme presented superior conversion efficiency compared to MMLV (FIG. 13). This experiment indicated that even at low amounts of template (0.00025 µM), the R2 enzyme was capable of RNA library prep (FIG. 13, number 4). This is representative of single cell applications. This experiment also showed a 10 fold greater conversion efficiency as compared to currently available methods.

TABLE 9-continued

| Reagents | volume | |
|---|---|---|
| SYBRFAST master mix | | |
| 100 µM primer (P161) | 0.125 µl | |
| 100 µM primer (P172) | 0.125 µl | |
| 10X template (or RT reaction) | 2.5 µl | |
| Total | 25 µl | |
| Thermocycling | | |
| 95° C. | 3 minutes | |
| 95° C. | 3 seconds | |
| 64° C. | 20 seconds | 30 cycles |
| 68° C. | 2' | |

TABLE 7

| Reaction | 1 | 2 | 3 | 4 | 5 | 6 | 7 | 8 |
|---|---|---|---|---|---|---|---|---|
| H₂O | 34.95 µl | 34.45 µl | 34.9 µl | 34.945 µl | 35.25 µl | 34.75 µl | 35.2 µl | 35.245 µl |
| 5X R2 buffer | 10 µl | 10 µl | 10 µl | 10 µl | 0 µl | 0 µl | 0 µl | 0 µl |
| 5X MMLV buffer | 0 µl | 0 µl | 0 µl | 0 µl | 10 µl | 10 µl | 10 µl | 10 µl |
| 10 mM dNTPs | 1.25 µl | 1.25 µl | 1.25 µl | 1.25 µl | 1.25 µl | 1.25 µl | 1.25 µl | 1.25 µl |
| 2.5 µM 600bpRNA-P172 | 0 µl | 0.5 µl | 0.05 µl | 0.005 µl | 0 µl | 0.5 µl | 0.05 µl | 0.005 µl |
| 100 µM P181 TSO | 0 µl | 0 µl | 0 µl | 0 µl | 3 µl | 3 µl | 3 µl | 3 µl |
| 100 µM P173 | 0.05 µl | 0.05 µl | 0.05 µl | 0.05 µl | 0 µl | 0 µl | 0 µl | 0 µl |
| 0.3 µg/µl P8 (R2 enzyme) | 3.75 µl | 3.75 µl | 3.75 µl | 3.75 µl | 0 µl | 0 µl | 0 µl | 0 µl |
| 40 unit/µl MMLV-RT (Clontech) | 0 µl | 0 µl | 0 µl | 0 µl | 0.5 µl | 0.5 µl | 0.5 µl | 0.5 µl |
| Total | 50 µl | 50 µl | 50 µl | 50 µl | 50 µl | 50 µl | 50 µl | 50 µl |

TABLE 8

| Reagents | volume | |
|---|---|---|
| H₂O | 9.75 µl | |
| 2X SYBRFAST master mix | 12.5 µl | |
| 100 µM primer (P186) | 0.125 µl | |
| 100 µM primer (P172) | 0.125 µl | |
| 10X template (or RT reaction) | 2.5 µl | |
| Total | 25 µl | |
| Thermocycling | | |
| 95° C. | 3 minutes | |
| 95° C. | 3 seconds | |
| 54° C. | 10 seconds | 30 cycles |
| 64° C. | 20 seconds | |
| 68° C. | 2' | |

TABLE 9

| Reagents | volume |
|---|---|
| H₂O | 9.75 µl |
| 2X | 12.5 µl |

P173 (RNA template)
CAGUCAGUCAGUCAGUCAGUGCCAAAUGCCUCGUCAUC 600 bp RNA
GGAUCCUCUAGAGUCGACCUGCAGGCAUGCAAGCUUGGCACUGGCC

GUCGUUUUACAACGUCGUGACUGGGAAAACCCUGGCGUUACCCAAC

UUAAUCGCCUUGCAGCACAUCCCCCUUUCGCCAGCUGGCGUAAUAG

CGAAGAGGCCCGCACCGAUCGCCCUUCCCAACAGUUGCGCAGCCUG

AAUGGCGAAUGGCGCCUGAUGCGGUAUUUUCUCCUUACGCAUCUGU

GCGGUAUUUCACACCGCAUAUGGUGCACUCUCAGUACAAUCUGCUC

UGAUGCCGCAUAGUUAAGCCAGCCCCGACACCCGCCAACACCCGCU

GACGCGCCCUGACGGGCUUGUCUGCUCCCGGCAUCCGCUUACAGAC

AAGCUGUGACCGUCUCCGGGAGCUGCAUGUGUCAGAGGUUUUCACC

GUCAUCACCGAAACGCGCGAGACGAAAGGGCCUCGUGAUACGCCUA

UUUUUAUAGGUUAAUGUCAUGAUAAUAAUGGUUUCUUAGACGUCA

```
GGUGGCACUUUUCGGGGAAAUGUGCGCGGAACCCCUAUUUGUUUA

UUUUUCUAAAUACAUUCAAAUAUGUAUCCGCUCAUGAGACAAUAA

CCCUG

P186
CAGTCAGTCAGTCAGTCAGTGCCA

P172
CAGGGTTATTGTCTCATGAGCG

P161
GTTAATAACGAAATGAGCAGCC

P181
GTTAATAACGAAATGAGCAGCCrGrGrG

P170
GCCATTCGCCATTCAGGCTGC
```

Figure 14:
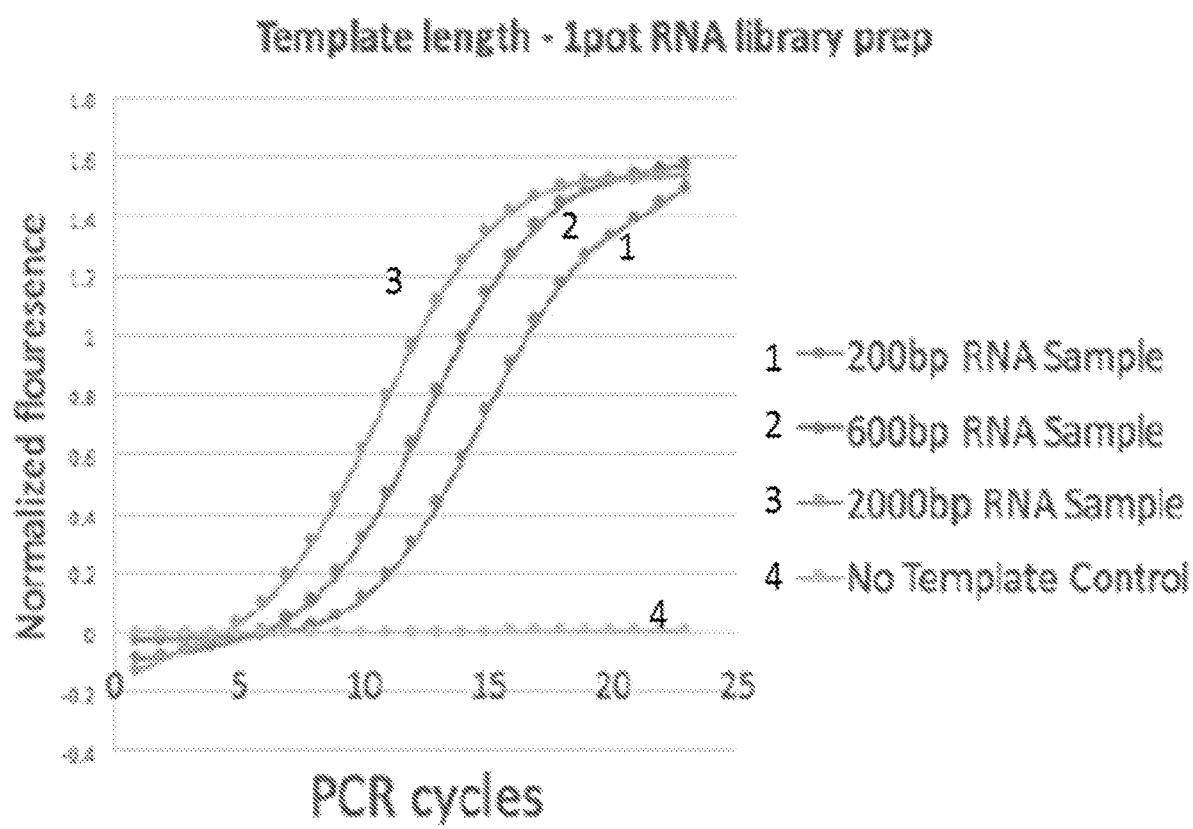
FIG. 14 illustrates 1-pot (e.g., single vessel) RNA library preparation with different template lengths.

Example 6: 1-Pot (Single-Vessel) RNA Library Prep Using Various Template Lengths This experiment was designed to demonstrate a method for preparing 1-pot (single vessel) RNA library using different lengths of template RNA (200 bp 600 bp, and 2000 bp). A schematic of the workflow is shown in FIG. 3. In brief, the reactions included $H_2O$, R2 buffer, 0.25 mM dNTPs, RNA with primer (e.g., 0.3 μM (200 bp) 0.125 μM (600 bp), or 0.03 μM (2000 bp)), 0.1 μM of P173, and enzyme (e.g. 0.023 μg/l of modified R2 enzyme; P2 variant) (TABLE 10). The reactions were incubated at 30° C. for 1 hour. The reactions were then supplemented with PCR reagents including amplification primers and hot-start polymerase. The PCR amplification reactions included $H_2O$, SYBR FAST master mix, 0.5 μM each of forward primer and reverse primer, and 2.5 μl of 10× template (RT reaction) (TABLE 11). The forward and reverse primers for the no template control reaction were P186 and P183, respectively. The forward and reverse primers for the 200 bp RNA template reaction were P186 and P170, respectively. The forward and reverse primers for the 600 bp RNA template reaction were P186 and P172, respectively. The forward and reverse primers for the 2000 bp RNA template reaction were P186 and P183, respectively. The PCR conditions for the reactions were 95° C. for 3 minutes and 30 cycles of 95° C. for 3 seconds and 62° C. for 60 seconds. The reactions were then increased to 68° C. No purification step was needed during the course of this experiment. The initial reaction can be diluted 10-fold during PCR by adding 10 μl of the RT reaction and 90 μl PCR reagents to the same tube, making it a 1-pot (single vessel) reaction. The results using real-time PCR showed product conversion at various lengths of RNA template (FIG. 14). This experiment also illustrates RNA length compatibility. The experiment shows compatibility with several transcript lengths and enables applications such as Iso-seq, VDJ, and others.

TABLE 10

| Reaction | 1 | 2 | 3 | 4 |
|---|---|---|---|---|
| $H_2O$ | 30 μl | 27.5 μl | 27.5 μl | 27.5 μl |
| 5X R2 buffer | 10 μl | 10 μl | 10 μl | 10 μl |
| 10 mM dNTPs | 1.25 μl | 1.25 μl | 1.25 μl | 1.25 μl |
| 2.5 μM 600 bpRNA-P172 | 0 μl | 0 μl | 2.5 μl | 0 μl |
| 0.6 μM 2000 bpRNA-P184 | 0 μl | 0 μl | 0 μl | 2.5 μl |
| 6 μM 200 bpRNA-P170 | 0 μl | 2.5 μl | 0 μl | 0 μl |
| 1 μM P173 | 5 μl | 5 μl | 5 μl | 5 μl |
| 0.3 μg/μl P2 (R2 enzyme) | 3.75 μl | 3.75 μl | 3.75 μl | 3.75 μl |
| Total | 50 μl | 50 μl | 50 μl | 50 μl |

TABLE 11

| Reagents | volume | |
|---|---|---|
| $H_2O$ | 7.5 μl | |
| 2X SYBRFAST master mix | 12.5 μl | |
| 10 μM forward primer | 1.25 μl | |
| 10 μM reverse primer | 1.25 μl | |
| 10X template (RT reaction) | 2.5 μl | |
| Total | 25 μl | |
| Thermocycling | | |
| 95° C. | 3 minutes | |
| 95° C. | 3 seconds | 30 cycles |
| 62° C. | 60 seconds | |
| 68° C. | 5' | |

```
200 bp RNA
GGAUCCUCUAGAGUCGACCUGCAGGCAUGCAAGCUUGGCACUGGCC

GUCGUUUUACAACGUCGUGACUGGGAAAACCCUGGCGUUACCCAA

CUUAAUCGCCUUGCAGCACAUCCCCCUUUCGCCAGCUGGCGUAAUA

GCGAAGAGGCCCGCACCGAUCGCCCUUCCCAACAGUUGCGCAGCCU

GAAUGGCGAAUGGC 600 bp RNA
GGAUCCUCUAGAGUCGACCUGCAGGCAUGCAAGCUUGGCACUGGCC

GUCGUUUUACAACGUCGUGACUGGGAAAACCCUGGCGUUACCCAA

CUUAAUCGCCUUGCAGCACAUCCCCCUUUCGCCAGCUGGCGUAAUA

GCGAAGAGGCCCGCACCGAUCGCCCUUCCCAACAGUUGCGCAGCCU

GAAUGGCGAAUGGCGCCUGAUGCGGUAUUUUCUCCUUACGCAUCU

GUGCGGUAUUUCACACCGCAUAUGGUGCACUCUCAGUACAAUCUG

CUCUGAUGCCGCAUAGUUAAGCCAGCCCCGACACCCGCCAACACCC

GCUGACGCGCCCUGACGGGCUUGUCUGCUCCCGGCAUCCGCUUACA

GACAAGCUGUGACCGUCUCCGGGAGCUGCAUGUGUCAGAGGUUUU

CACCGUCAUCACCGAAACGCGCGAGACGAAAGGGCCUCGUGAUACG

CCUAUUUUUAUAGGUUAAUGUCAUGAUAAUAAUGGUUUCUUAGAC

GUCAGGUGGCACUUUUCGGGGAAAUGUGCGCGGAACCCCUAUUUG
```

UUUAUUUUUCUAAAUACAUUCAAAUAUGUAUCCGCUCAUGAGACA

AUAACCCUG 2000 bp RNA
GGAUCCUCUAGAGUCGACCUGCAGGCAUGCAAGCUUGGCACUGGCC

GUCGUUUUACAACGUCGUGACUGGGAAAACCCUGGCGUUACCCAA

CUUAAUCGCCUUGCAGCACAUCCCCCUUUCGCCAGCUGGCGUAAUA

GCGAAGAGGCCCGCACCGAUCGCCCUUCCCAACAGUUGCGCAGCCU

GAAUGGCGAAUGGCGCCUGAUGCGGUAUUUCUCCUUACGCAUCU

GUGCGGUAUUUCACACCGCAUAUGGUGCACUCUCAGUACAAUCUG

CUCUGAUGCCGCAUAGUUAAGCCAGCCCCGACACCCGCCAACACCC

GCUGACGCGCCCUGACGGGCUUGUCUGCUCCCGGCAUCCGCUUACA

GACAAGCUGUGACCGUCUCCGGGAGCUGCAUGUGUCAGAGGUUUU

CACCGUCAUCACCGAAACGCGCGAGACGAAAGGGCCUCGUGAUACG

CCUAUUUUUAUAGGUUAAUGUCAUGAUAAUAAUGGUUUCUUAGAC

GUCAGGUGGCACUUUUCGGGGAAAUGUGCGCGGAACCCCUAUUUG

UUUAUUUUUCUAAAUACAUUCAAAUAUGUAUCCGCUCAUGAGACA

AUAACCCUGAUAAAUGCUUCAAUAAUAUUGAAAAAGGAAGAGUAU

GAGUAUUCAACAUUUCCGUGUCGCCCUUAUUCCCUUUUUUGCGGC

AUUUUGCCUUCCUGUUUUUGCUCACCCAGAAACGCUGGUGAAAGU

AAAAGAUGCUGAAGAUCAGUUGGGUGCACGAGUGGGUUACAUCGA

ACUGGAUCUCAACAGCGGUAAGAUCCUUGAGAGUUUUCGCCCCGA

AGAACGUUUUCCAAUGAUGAGCACUUUUAAAGUUCUGCUAUGUGG

CGCGGUAUUAUCCCGUAUUGACGCCGGGCAAGAGCAACUCGGUCGC

CGCAUACACUAUUCUCAGAAUGACUUGGUUGAGUACUCACCAGUC

ACAGAAAAGCAUCUUACGGAUGGCAUGACAGUAAGAGAAUUAUGC

AGUGCUGCCAUAACCAUGAGUGAUAACACUGCGGCCAACUUACUU

CUGACAACGAUCGGAGGACCGAAGGAGCUAACCGCUUUUUUGCAC

AACAUGGGGGAUCAUGUAACUCGCCUUGAUCGUUGGGAACCGGAG

CUGAAUGAAGCCAUACCAAACGACGAGCGUGACACCACGAUGCCUG

UAGCAAUGGCAACAACGUUGCGCAAACUAUUAACUGGCGAACUAC

UUACUCUAGCUUCCCGGCAACAAUUAAUAGACUGGAUGGAGGCGG

AUAAAGUUGCAGGACCACUUCUGCGCUCGGCCCUUCCGGCUGGCUG

GUUUAUUGCUGAUAAAUCUGGAGCCGGUGAGCGUGGGUCUCGCGG

UAUCAUUGCAGCACUGGGGCCAGAUGGUAAGCCCUCCCGUAUCGU

AGUUAUCUACACGACGGGGAGUCAGGCAACUAUGGAUGAACGAAA

UAGACAGAUCGCUGAGAUAGGUGCCUCACUGAUUAAGCAUUGGUA

ACUGUCAGACCAAGUUUACUCAUAUAUACUUUAGAUUGAUUUAAA

ACUUCAUUUUUAAUUUAAAAGGAUCUAGGUGAAGAUCCUUUUUGA

UAAUCUCAUGACCAAAAUCCCUUAACGUGAGUUUUCGUUCCACUG

AGCGUCAGACCCCGUAGAAAAGAUCAAAGGAUCUUCUUGAGAUCC

UUUUUUUCUGCGCGUAAUCUGCUGCUUGCAAACAAAAAAACCACC

GCUACCAGCGGUGGUUUGUUUGCCGGAUCAAGAGCUACCAACUCU

UUUUCCGAAGGUAACUGGCUUCAGCAGAGCGCAGAUACCAAAUAC

UGUCCUUCUAGUGUAGCCGUAGUUAGGCCACCACUUCAAGAACUC

UGUAGCACCGCCUACAUACCUCGCUCUGCUAAUCCUGUUACCAGUG

GCUGCUGCCAGUGGCGAUAAGUCGUGUCUUACCGGGUUGGACUCA

AGACGAUAGUU

P186
CAGTCAGTCAGTCAGTCAGTGCCA

P172
CAGGGTTATTGTCTCATGAGCG

P173 (RNA template)
CAGUCAGUCAGUCAGUCAGUGCCAAAUGCCUCGUCAUC

P183
TCGTCTTGAGTCCAACCCGGT

P170
GCCATTCGCCATTCAGGCTGC

P184
GAACACAGCATTAGCAGCTCGTCTTGAGTCCAACCCGGT

Figure 15:
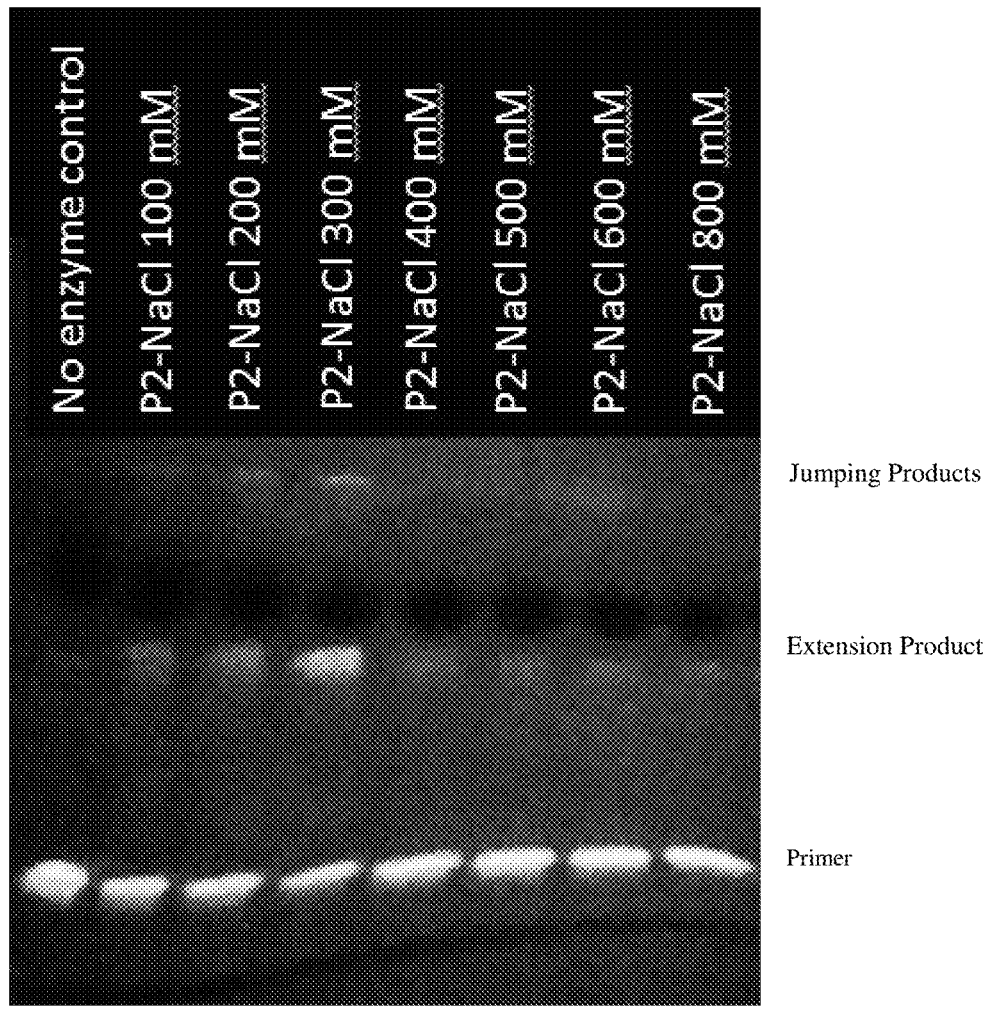
FIG. 15 illustrates that enzyme activity and template jumping is dependent on the concentration of sodium chloride (NaCl)

Example 7: Optimization of NaCl Concentration for Enzyme Activity and Template Jumping This experiment was designed to optimize enzyme activity and template jumping based on NaCl concentration. In brief, the reactions included $H_2O$, 10× R2 buffer, 0.1 mM dNTPs, 0.2 μM RNA template with primer (P173 and P174), NaCl (100 mM, 200 mM, 300 mM, 400 mM, 500 mM, 600 mM, or 800 mM), and enzyme (e.g., 0 μg or 0.023 μg of modified R2 enzyme (P2 variant R2 enzyme)). The 10× R2 buffer included $H_2O$, 500 mM Tris-HCl pH 7.5, 0.5% tween, and 25 mM DTT (42.5 μl $H_2O$, 50 μl of 1000 mM Tris-HCl pH 7.5, 5 μl of 10% Tween, 2.5 μl of 1000 mM DTT). The reactions were incubated at room temperature for about 2 hours. The reactions were then supplemented with 0.5 μM of template (P173) and 5 $MgCl_2$ and incubated at room temperature for about 1 hour followed by 80° C. for about 5 minutes. The reactions were then run on a gel (FIG. 15). Results suggested that 300 mM NaCl was optimum for enzyme activity and template jumping in this experiment (FIG. 15).

TABLE 12

| Reaction | Lane 1 No enzyme control | Lane 2 NaCl 100 mM | Lane 3 NaCl 200 mM | Lane 4 NaCl 300 mM | Lane 5 NaCl 400 mM | Lane 6 NaCl 500 mM | Lane 7 NaCl 600 mM | Lane 8 NaCl 800 mM |
|---|---|---|---|---|---|---|---|---|
| H$_2$O | 16.1 µl | 14.6 µl | 14.2 µl | 13.8 µl | 13.4 µl | 13 µl | 12.6 µl | 11.8 µl |
| 10X R2 buffer (no MgCl$_2$; low NaCl) | 2 µl | 2 µl | 2 µl | 2 µl | 2 µl | 2 µl | 2 µl | 2 µl |
| 5000 mM NaCl | 0.4 µl | 0.4 µl | 0.8 µl | 1.2 µl | 1.6 µl | 2 µl | 2.4 µl | 3.2 µl |
| 10 mM dNTPs | 0.2 µl | 0.2 µl | 0.2 µl | 0.2 µl | 0.2 µl | 0.2 µl | 0.2 µl | 0.2 µl |
| 20 µM template/primer (P173 + P174) | 0.2 µl | 0.2 µl | 0.2 µl | 0.2 µl | 0.2 µl | 0.2 µl | 0.2 µl | 0.2 µl |
| 0.3 µg/µl P2 (R2 enzyme) | 0 µl | 1.5 µl | 1.5 µl | 1.5 µl | 1.5 µl | 1.5 µl | 1.5 µl | 1.5 µl |
| RT for 2 hours | | | | | | | | |
| 100 µM P173 | 0.1 µl | 0.1 µl | 0.1 µl | 0.1 µl | 0.1 µl | 0.1 µl | 0.1 µl | 0.1 µl |
| 100 mM MgCl$_2$ | 1 µl | 1 µl | 1 µl | 1 µl | 1 µl | 1 µl | 1 µl | 1 µl |
| Total | 20 µl | 20 µl | 20 µl | 20 µl | 20 µl | 20 µl | 20 µl | 20 µl |

RT for 1 hour then 80° C. for 5 minutes

Figure 16A:
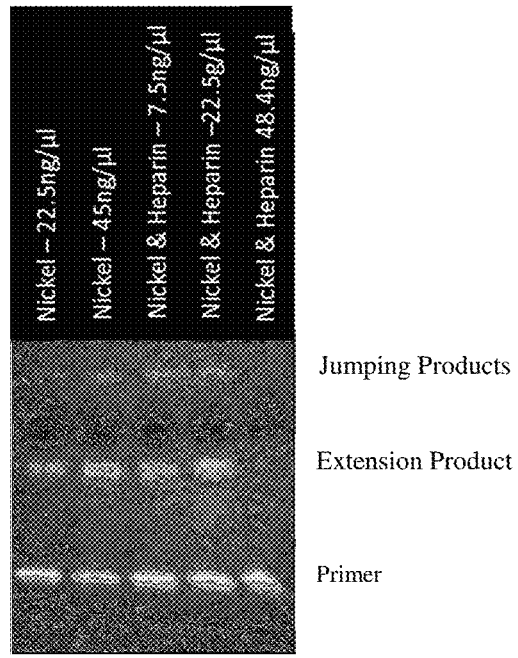
FIG. 16A illustrates enzyme activity after nickel and/or heparin affinity purification visualized based on fluorescently labeled primer (fluorescein)
Figure 16B:
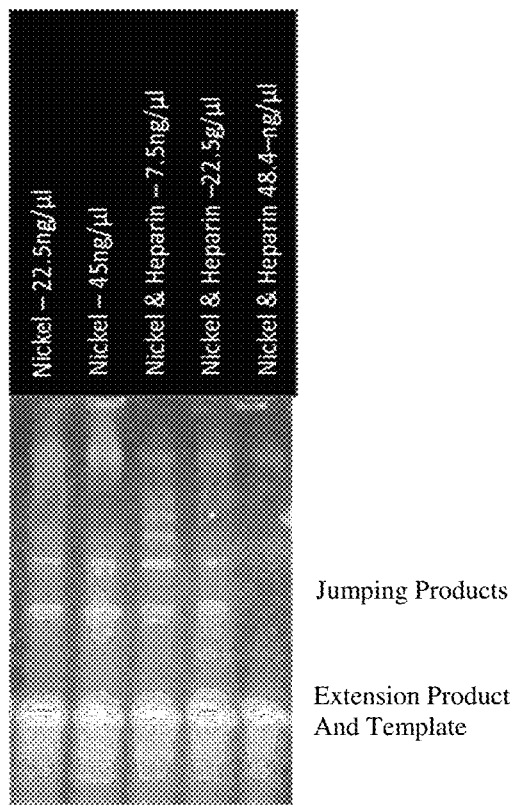
FIG. 16B illustrates template jumping properties after nickel and/or heparin affinity purification visualized based on Sybr gold staining.

Example 5: Two Step Purification of R2 Enzyme (P2 Variant) Yielded Hither Activity and Template Jumping This experiment was designed to optimize the activity and template jumping properties of an R2 enzyme based on different purification methods. In brief, the reactions included H$_2$O, 10× R2 buffer, 0.1 mM dNTPs, 0.2 µM RNA with primer (P173 and P174), 5 mM MgCl$_2$, NaCl, 0.5 µM of P173, and enzyme (0.023 µg/µl or 0.045 µg of P2 variant R2 enzyme for one step purification (nickel or heparin) or 0.0075 µg/µl, 0.023 µg/µl, or 0.048 µg/µl of P2 variant R2 enzyme for two step purification (nickel and heparin)). The reactions were incubated at room temperature for about 2 hours followed by 80° C. for about 5 minutes. The reactions were then run on a gel (FIGS. 16A and 16B). Results suggested that reactions where the enzyme was subjected to Ni-NTA nickel affinity column followed by further purification with heparin sepharose affinity column showed higher activity and better template jumping capabilities than reactions subjected to only one purification step (nickel alone or heparin alone) (FIGS. 16A and 16B).

Figure 17:
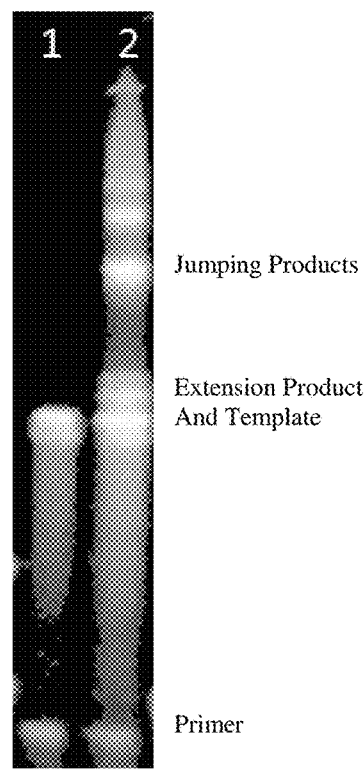
FIG. 17 illustrates R2 enzyme activity and template jumping in the presence of DNA template (lane 1: no enzyme control; lane 2: 0.023 μg/μl enzyme in the presence of DNA template)

Example 9: DNA Template Allows for R2 Enzyme (P2 Variant) Activity and Template Jumping This experiment demonstrated that a modified reverse transcriptase enzyme showed activity and template jumping capabilities in the presence of DNA template (FIG. 17). In short, the reaction included H$_2$O, 5× R2 buffer, 0.25 mM dNTPs, 0.4 µM DNA template with primer (P188 and P189), 0 µM or 1.5 µM of DNA template (P188) (FIG. 17, lanes 1 and 2, respectively), and 0 µg/l or 0.023 µg/µl enzyme (P2 variant R2 enzyme) (FIG. 17, lanes 1 and 2, respectively). The reactions were incubated at 30° C. for about 1 hour followed by 80° C. for about 10 minutes. The reactions were then run on a gel (FIG. 17). Sequences:

```
DNA template P188
(AATGATACGGCGACCACCGAGATCTACACTCTTTCCCTACACGAC
GCTCTTCCGATCT);

primer P189
(AGATCGGAAGAGCGTCGTGTAG).
```

Example 10: DNA Fragments can be Captured and Tagged with R2 Enzyme

This experiment showed that a 200 bp DNA fragment (typical size for cfDNA) was captured and tagged in a 1-pot (single vessel) reaction using the methods of the present disclosure. Some facts of this experiment: no prior knowledge of the sequence was required and the data provided by this experiment met the sensitivity requirement (a typical liquid biopsy sample has between about 10-30 ng of DNA, a required sensitivity of 0.1% (~10-30 µg)).

Figure 18A:
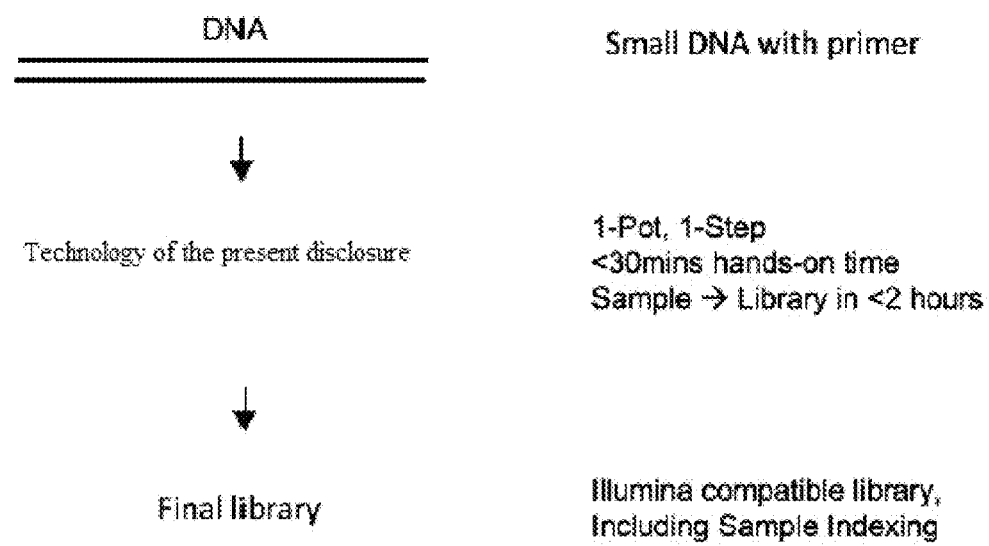
FIG. 18A illustrates a workflow of a method of the present disclosure for sequencing a library preparation from liquid biopsy.
Figure 18B:
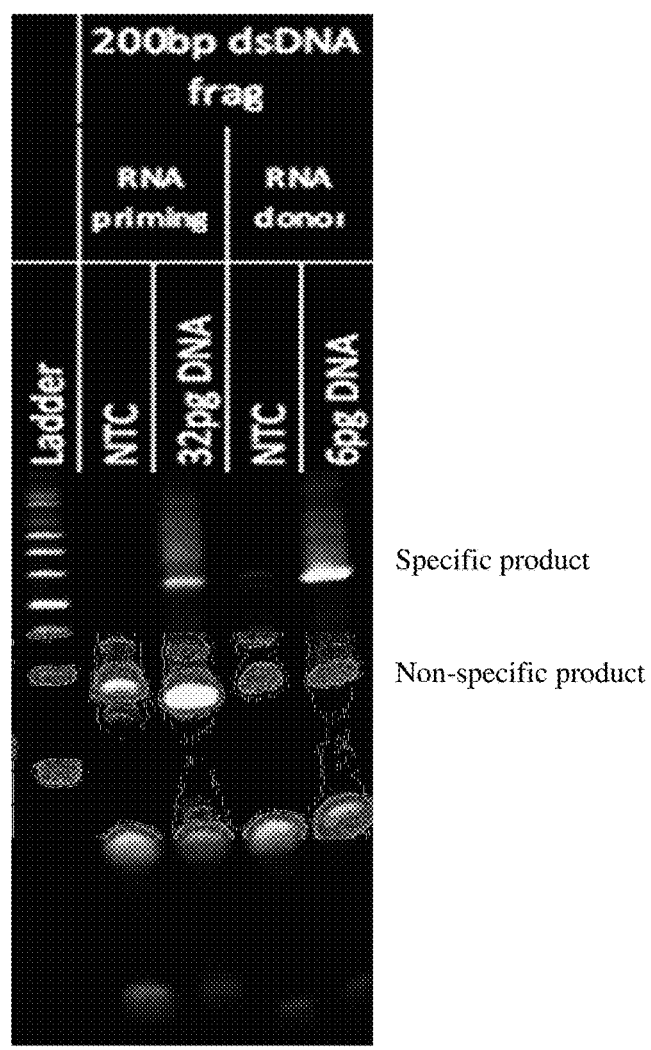
FIG. 18B illustrates that a sample DNA fragment was captured by an R2 enzyme with both an RNA priming approach and an RNA donor approach.
Figure 18C:
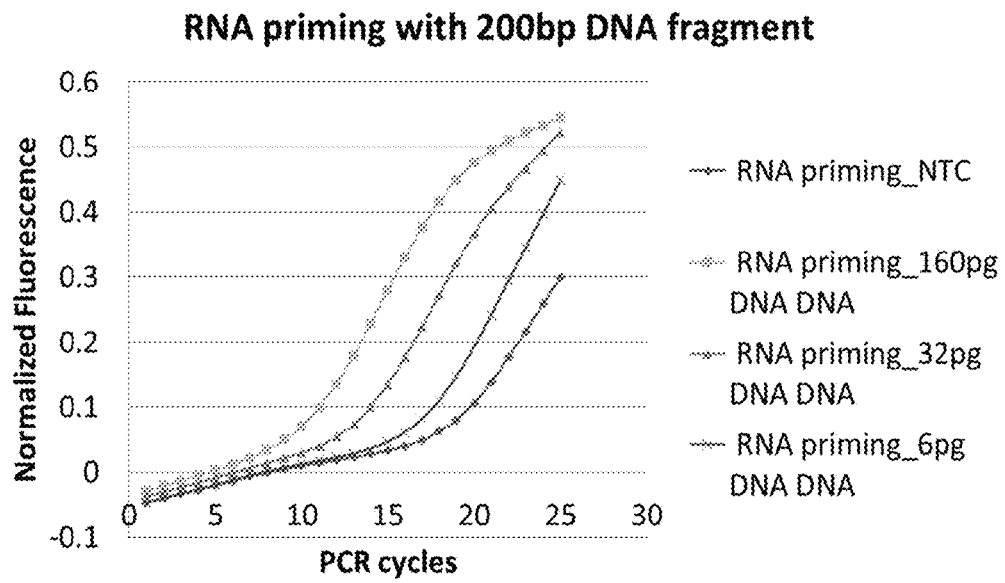
FIG. 18C illustrates that a sample DNA fragment (at various concentrations) was captured by an R2 enzyme using an RNA priming approach.
Figure 18D:
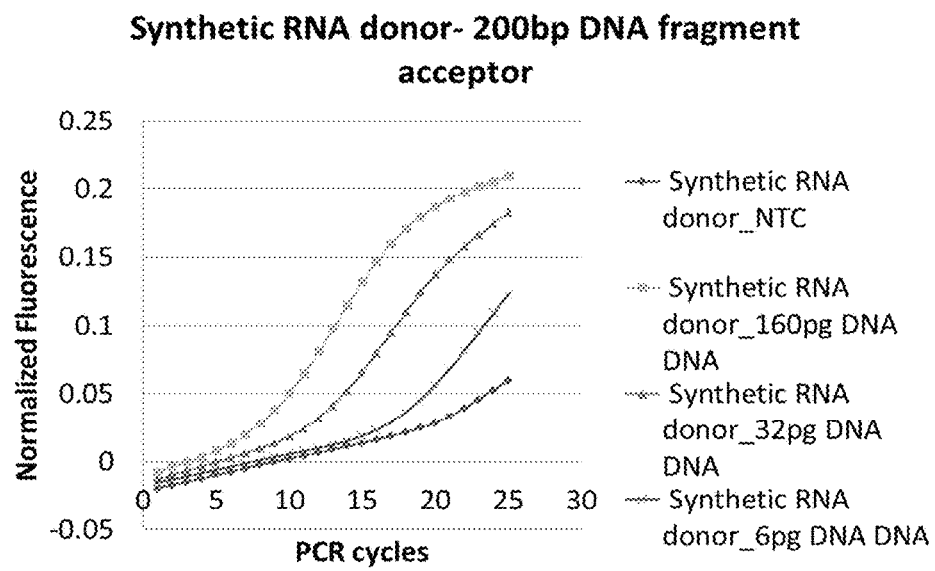
FIG. 18D illustrates that a sample DNA fragment (at various concentrations) was captured by an R2 enzyme using an RNA donor approach.

This experiment showed that 1-pot (single vessel) reaction containing DNA fragments (200 bp PCR product prepared by heat denaturation and quick cooling of PCR product) was captured and tagged using an R2 enzyme (P8 variant R2 enzyme). In brief, this experiment included two approaches: 1) capture of DNA fragment with RNA priming (schematic shown in FIGS. 5A and 5B); and 2) capture of DNA fragment using RNA donor (schematic shown in FIGS. 6A and 6B). Briefly, the reactions per the first approach (RNA priming) included H$_2$O, 5× R2 buffer, 0.25 mM dNTPs, 200 bp DNA fragment (0 ng (no DNA template control (NTC)), 160 µg, 32 µg, or 6 µg of DNA template), enzyme (e.g., 0.023 µg/p P8 variant R2 enzyme), and 0.5 µM of P173. The reactions per the second approach (RNA donor) included H$_2$O, 5× R2 buffer, 0.25 mM dNTPs, 200 bp DNA fragment (0 ng (no DNA template control (NTC)), 160 µg, 32 µg, or 6 µg), enzyme (e.g., 0.023 µg/µl P8 variant R2 enzyme), and 0.2 µM RNA donor (P73+P174). The reactions were then incubated at 30° C. for about 1 hour. The reactions were then diluted 1:10 and supplemented with PCR reagents including amplification primers and hot-start polymerase. The PCR amplification reactions for the first approach (RNA priming) included H$_2$O, 1× taq master mix with 1× SYBR Green, 0.5 µM of P169, 0.5 µM of P186, and 1× template (10 µl RT reaction in 100 µl total volume for PCR). The PCR amplification reactions for the second approach (RNA donor) included H$_2$O, 1× Taq Mastermix with 1× sybr green, 0.5 µM of P169, 0.5 µM of P186, and 1× template (10 µl RT reaction in 100 µl total volume for PCR). The PCR conditions for the reactions were 95° C. for 3 minutes and 30 cycles of 95° C. for 3 seconds, 54° C. for 10 seconds, and 64° C. for 10 seconds. The reactions were then increased to 68° C. for 2'. The length of the PCR products was confirmed on an acrylamide gel. The results showed that the DNA fragment (~200 bp) was captured using either the RNA priming or the donor RNA mechanism without prior knowledge of the DNA sequence. The expected PCR product was about 240 bp, which is about the size of the DNA template in addition to the RNA donor (FIG. 18B). See, FIGS. 18A, 18B, 18C, and 18D.
Sequences:

```
200 bp DNA fragment (PCR product)
CTGCAGTAATACGACTCACTATAGGATCCTCTAGAGTCGACCTGCAGG

CATGCAAGCTTGGCACTGGCCGTCGTTTTACAACGTCGTGACTGGGAA

AACCCTGGCGTTACCCAACTTAATCGCCTTGCAGCACATCCCCCTTTC

GCCAGCTGGCGTAATAGCGAAGAGGCCCGCACCGATCGCCCTTCCCA

ACAGTTGCGCAGCCTGAATGGCGAATGGC

P169
CTGCAGTAATACGACTCACTATAGGATCCTCTAGAGTCGACCTGC

P186
CAGTCAGTCAGTCAGTCAGTGCCA

P173 (RNA template)
CAGUCAGUCAGUCAGUCAGUGCCAAAUGCCUCGUCAUC

P174
TGATGACGAGGCATTTGGC
```

Example 11: Limit of Detection for DNA Template Using R2 Enzyme

Figure 19:
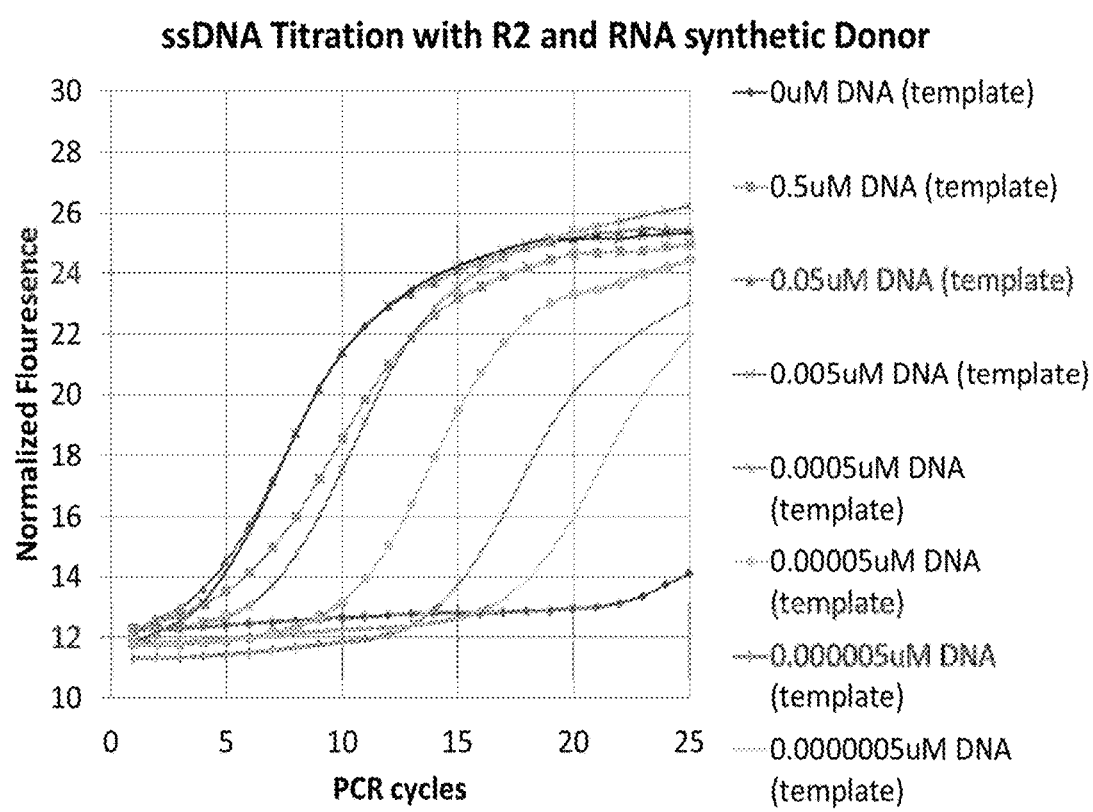
FIG. 19 illustrates that a sample DNA fragment was captured using an RNA donor approach at a concentration as low as 500 femtomolar.

This experiment analyzed the limit of detection for DNA template using RNA donor strategy for capturing 58 bp DNA oligonucleotide (P188). In short, the reactions included H$_2$O, 5× R2 buffer, 0.25 mM dNTPs, DNA fragment/P188 (0 µM, 0.5 µM, 0.05 µM, 0.005 µM, 0.0005 µM, 0.00005 µM, 0.000005 µM, and 0.0000005 µM), enzyme (e.g., 0.023 µg P8 variant R2 enzyme), and 0.4 µM RNA with annealed DNA primer (P173/P174). The reactions were then incubated at 30° C. for about 1 hour and 80° C. for about 10 minutes. The reactions were then subjected to 5 fold dilution and supplemented with PCR reagents including amplification primers and hot-start polymerase. The PCR amplification reactions included H$_2$O, SYBRFAST master mix, 0.25 µM of P188, 0.25 µM of P174, and 1× template (2.5 µl of RT reaction in 25 µl total volume). The PCR conditions for the reactions were 95° C. for 3 minutes and 30 cycles of 95° C. for 3 seconds, 54° C. for 10 seconds, and 64° C. for 10 seconds. The reactions were then increased to 68° C. for 2'. FIG. 19 shows that a nice titration was observed for the different amounts of template DNA while the no template control (0 µM DNA) remained clean at 20 PCR cycles. Titration was observed for low concentrations of DNA template (concentration as low as 500 femtomolar DNA). This experiment also suggests that there may be inhibitory effects at high DNA template concentrations.
Sequences:

```
P188
AATGATACGGCGACCACCGAGATCTACACTCTTTCCCTACACGACGCT

CTTCCGATCT

P173 (RNA template)
CAGUCAGUCAGUCAGUCAGUGCCAAAUGCCUCGUCAUC

P174
TGATGACGAGGCATTTGGC
```

Example 12: Sensitivity Driver for Liquid Biopsy Application

Figure 20:
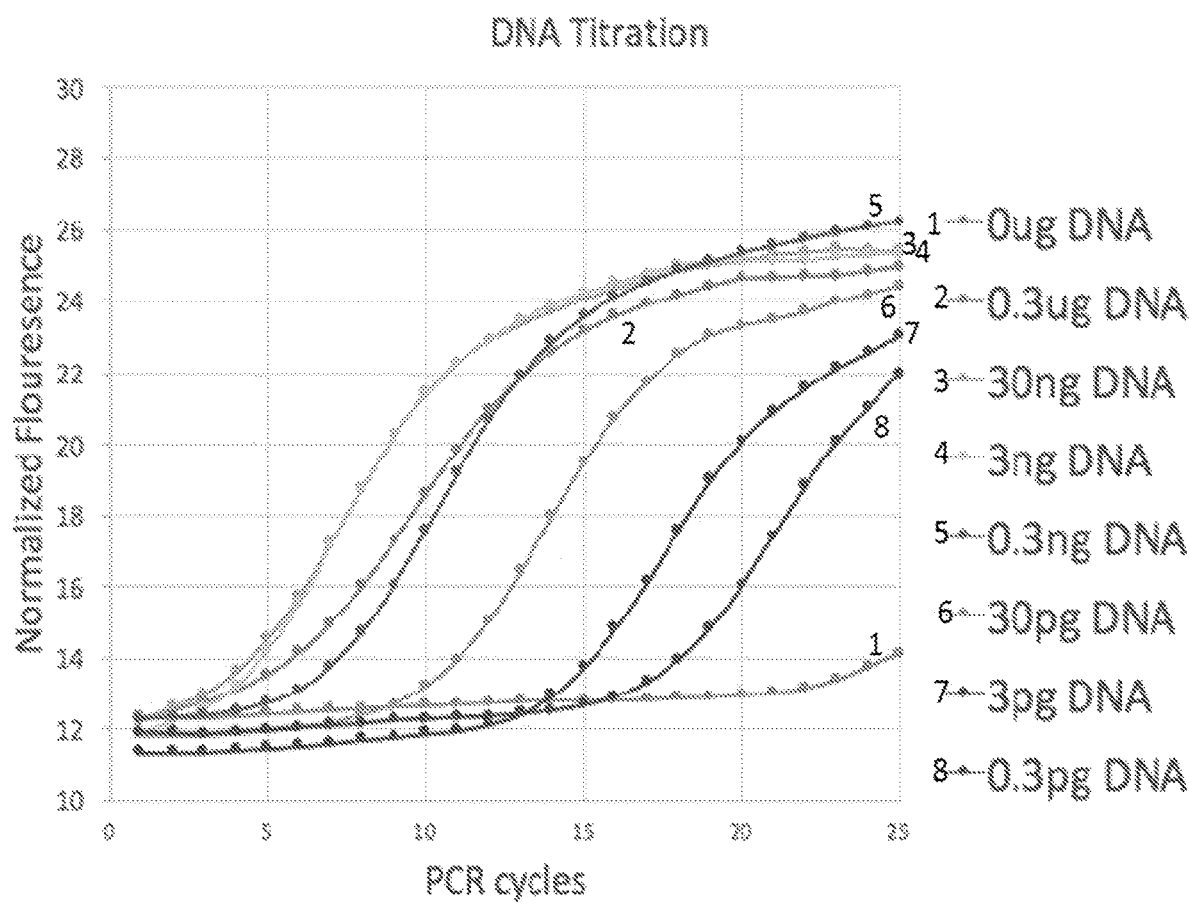
FIG. 20 illustrates that the method of the present disclosure can be used for liquid biopsy application.
Figure 21:
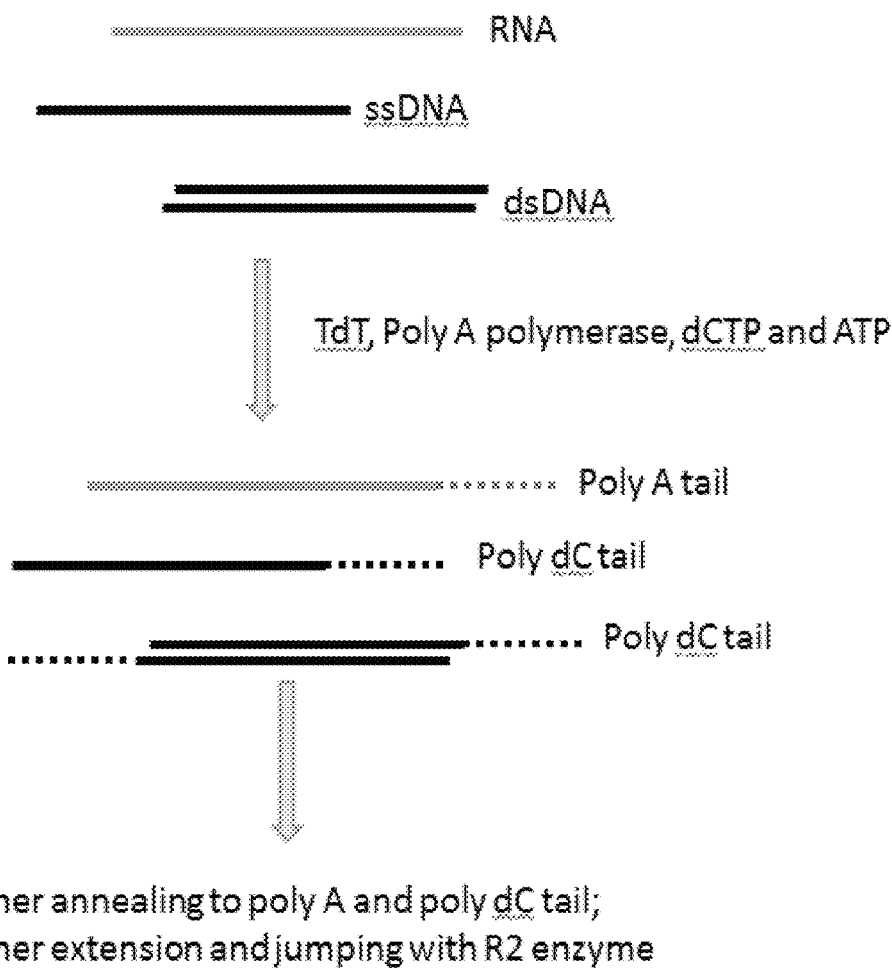
FIG. 21 illustrates a method of the present disclosure that takes advantage of detecting mutations on both RNA (e.g., exosomal RNA) and cell-free DNA. This method can be used to detect rare mutations or low frequency mutations (e.g., some mutated alleles can occur at less than 1 copy per mL of plasma) by increasing the detection sensitivity by combining RNA and cell-free DNA. This method can be used, for example, to test analytes isolated from body fluids (e.g., blood). Body fluids, such as blood plasma, may contain different cell-free sources of nucleic acids. Such cell-free sources can be circulating cell-free DNA (e.g., double-stranded DNA (dsDNA) and single-stranded DNA (ssDNA)) and RNA (e.g., extracellular RNA (exRNA) and RNA from exosomes). Cell-free DNA can be present at various stages of fragmentation and/or degradation (e.g., different lengths). Extracellular RNA can include, but is not limited to, messenger RNA (mRNA), transfer RNA (tRNA), microRNA (miRNA), small interfering RNA (siRNA), and long non-coding RNA (lncRNA).
Figure 22C:
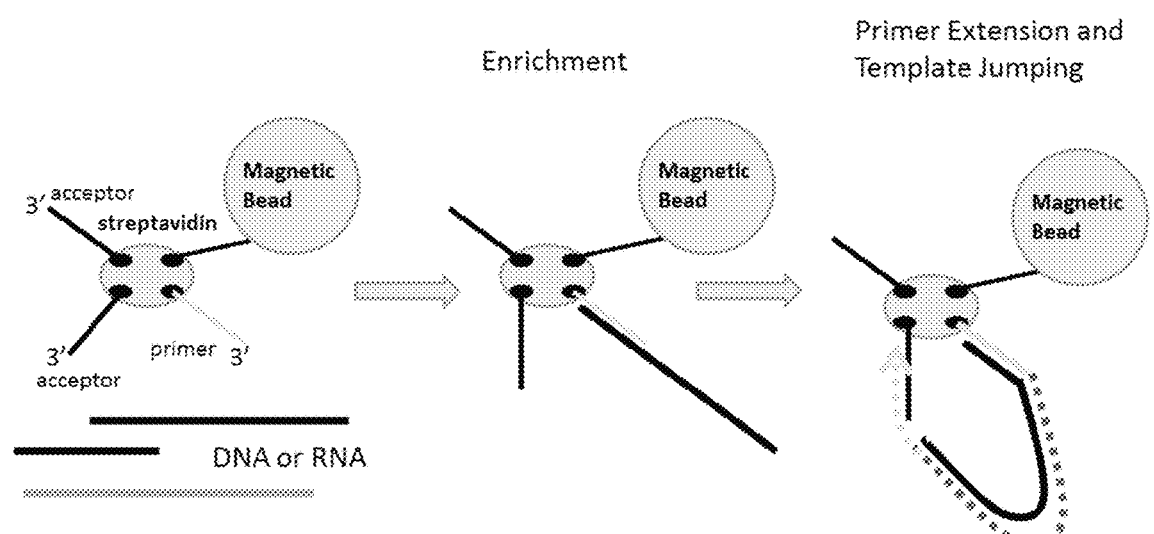
FIG. 22C illustrates that a complex comprising of streptavidin bound to an oligonucleotide primer, an oligonucleotide acceptor, and a magnetic bead is capable of binding to specific DNA and/or RNA template(s). In this case, the specific template is first enriched with magnetic beads. The template is then copied in the presence of an enzyme (e.g., R2 enzyme) and the extended sequence can further undergo template jumping.
Figure 23A:
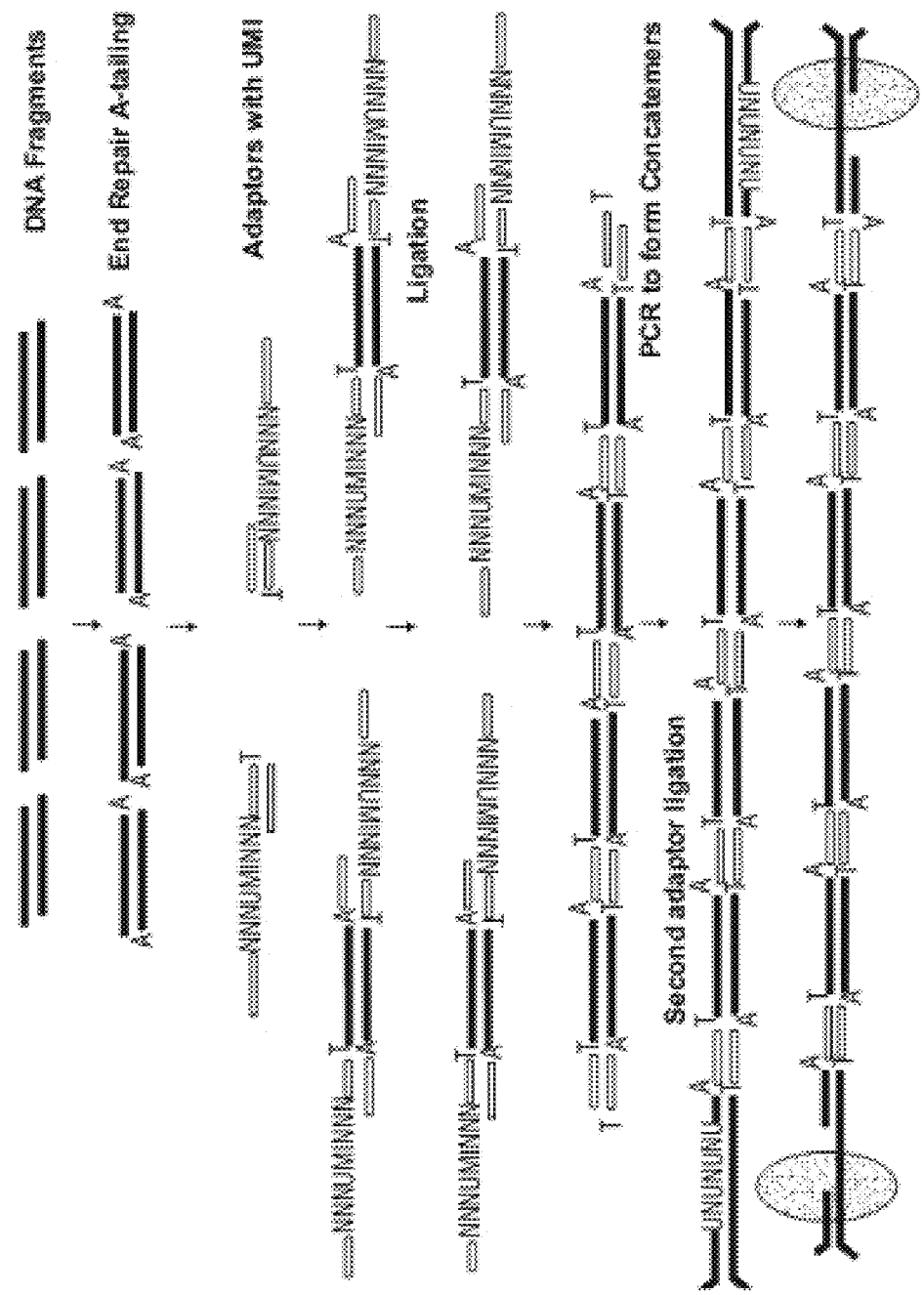

This experiment shows DNA titration and sensitivity of up to 0.3 µg of DNA. Similar protocol as previously described in the above examples (e.g., example 11) was followed with DNA template concentration of 0 µg, 0.3 µg, 30 ng, 3 ng, 0.3 ng, 30 µg, 3 µg, or 0.3 µg (see, FIG. 20). Currently, none of the next generation sequencing sample preparation technology holds this capability for sensitivity. This experiment shows 100-1000 fold higher sensitivity than any current available method. Data shows potential for applications with DNA with a few orders of magnitude lower than 0.3 µg.

Example 13: Template Concatemerization

Figure 24A:
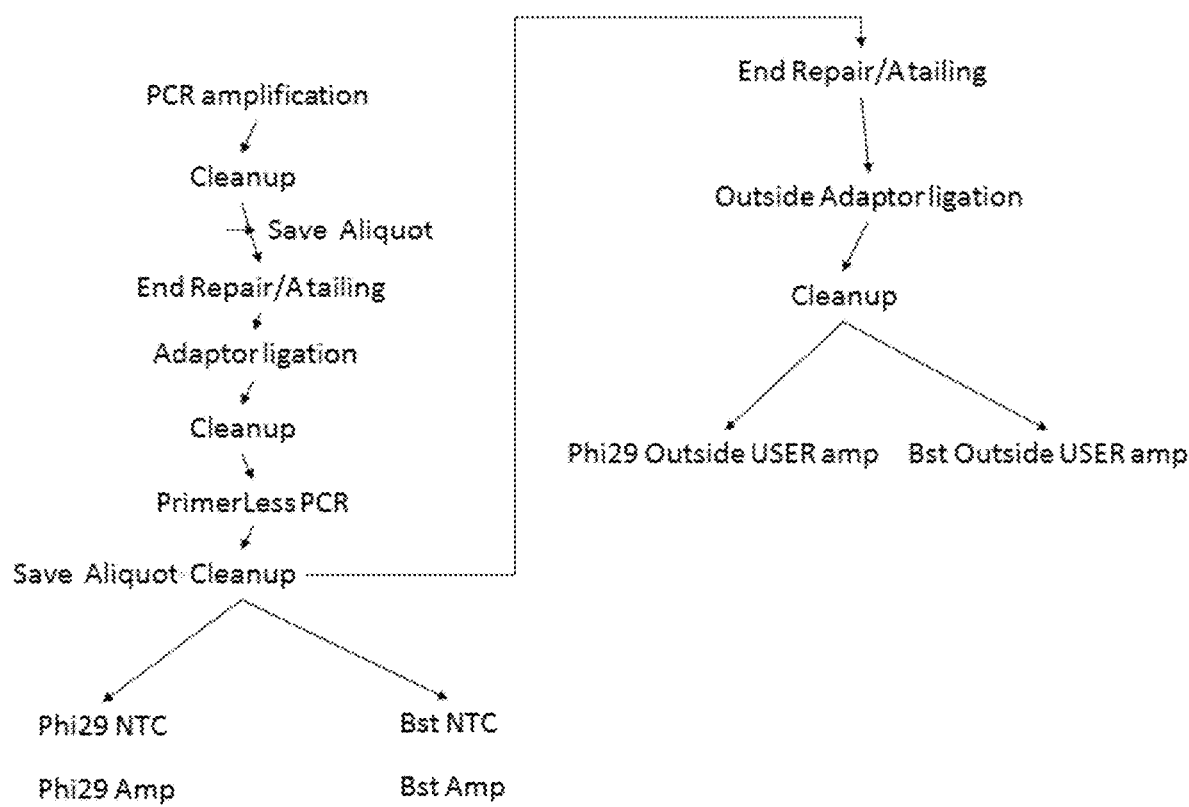
FIG. 24A illustrates a workflow of template concatemerization of the present disclosure.
Figure 24B:
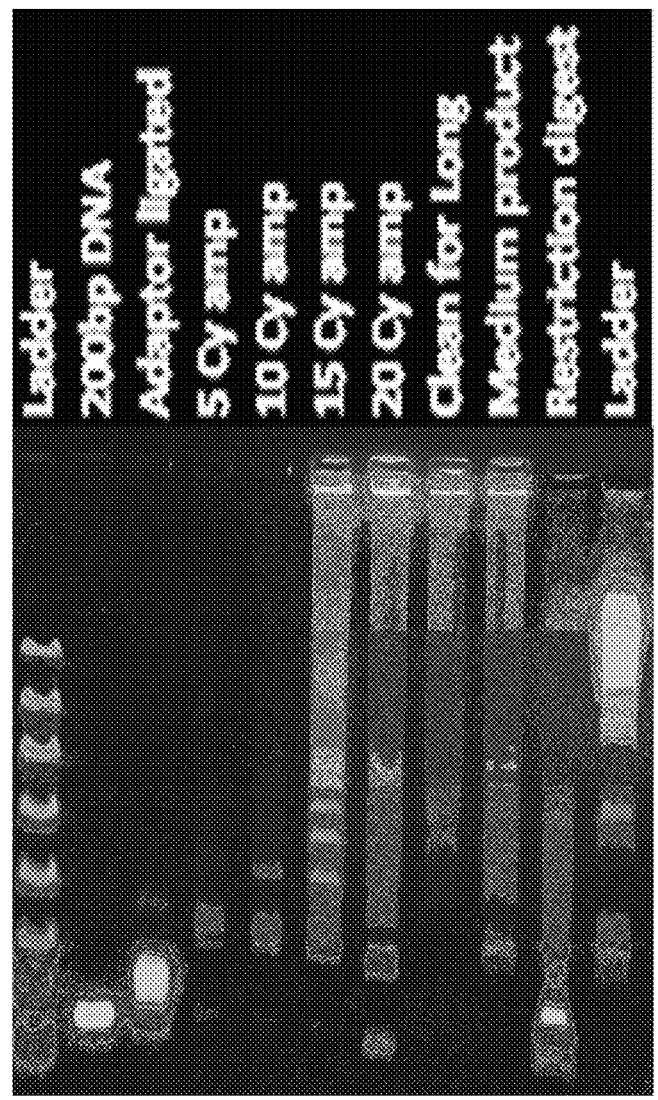
FIG. 24B illustrates a gel showing the concatemerization of a 200 bp DNA fragment.
Figure 25:
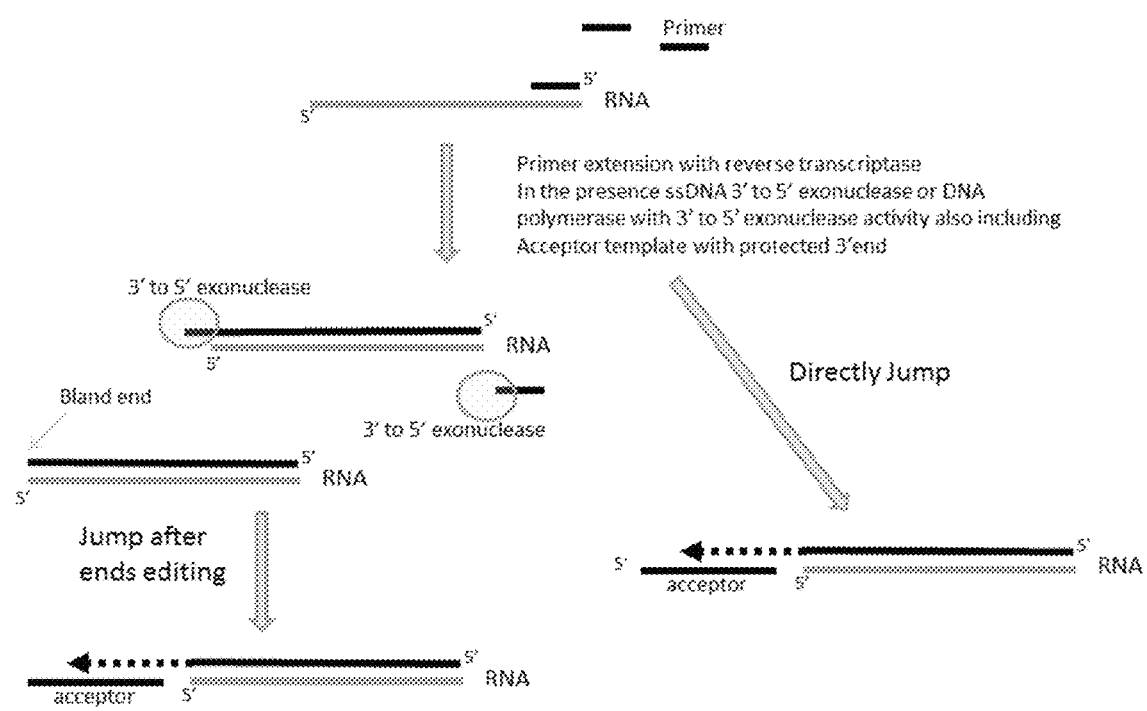
FIG. 25 illustrates a schematic reaction in the presence of a reverse transcriptase and a second enzyme or enzymatic activity (i.e., companion enzyme), such as an ssDNA 3' to 5' exonuclease or a polymerase with editing activity (e.g., 3' to 5' exonuclease). Examples of a companion enzyme include, but are not limited to, T4 DNA polymerase, exonuclease I, and exonuclease T. One function or purpose of the companion enzyme is to remove the excess of free unused extension primer. Free primer may contribute to unwanted products (e.g., free primer may serve as a jumping acceptor or it may be used as a nonspecific primer).

This experiment was designed to demonstrate a method for converting short DNA fragments into a concatemer. Concatemers may contain about 2, 3, 4, 5, 6, 7, 8, 9, 10, 20, 30, 40, 50, 60, 70, 80, 90, 100, 500, 1000, or more copies of the starting nucleic acid. A schematic of the workflow is shown in FIG. 24A. In brief, the initial PCR protocol for template preparation included H$_2$O, 2× Q5 master mix, P316 (0.5 µM). P317 (0.5 µM), and pUC18 (0.05 ng/µL). The PCR condition was 98° C. for 30 seconds followed by 30 cycles of: 98° C. for 10 seconds, 66° C. for 15 seconds, and 72° C. for 10 seconds. At the end of the 30 cycles, the reaction was kept at 72° C. for 2 minutes and then reduced to 4° C. The adaptor annealing reaction included H$_2$O, Tris pH 8.0 (20 mM), NaCl (100 mM), and two primers (25 µM each; (P312+P313) or (P314+P315) or (P320+P321)). The reaction was incubated at 90° C. for 1 minute, followed by 0.1° C./second ramp to 25° C. (20 seconds) and then reduced and kept at 4° C. The first adaptor ligation reaction included H$_2$O (30 µL), fragmented DNA (20 µL), end repair and T-tailing buffer (7 µL), and end repair and T-tailing enzyme mix (3 µL). The reaction was incubated at 20° C. for 30 minutes and then increased to 65° C. for 30 minutes. H$_2$O (5 µL) was then added to the reaction (50 µL) along with 2.5 µL of 20 µM adaptor (P312+P313), 2.5 µL of 20 µM adaptor (P314+P315), ligation buffer (30 µL), and DNA ligase (10 µL). The reaction was then incubated at room temperature for 15 minutes, followed by a reaction clean-up. SPRI beads were added and the reaction was eluted. The adaptor ligated library (10 µL) was incubated with H$_2$O (40 µL) and 2× Kappa HiFi master mix (50 µL) and subjected to PCR (98° C. for 45 seconds; 5 cycles of 98° C. for 15 seconds, 60° C. for 30 seconds, and 72° C. for 30 seconds; 72° C. for 1 minute; and kept at 4° C.). This protocol can be modified in order to increase the number of cycles (e.g., from 5 cycles to 25 cycles). The second adaptor ligation reaction comprises of a similar protocol as the one described for the first adaptor ligation reaction; the difference being that 5 µL of 20 µM adaptor (P320+P321) was used instead of 2.5 µL of 20 µM adaptor (P312+P313) and 2.5 µL of 20 µM adaptor (P314+P315). The gel in FIG. 24B shows that the adapters were successfully ligated to the fragmented DNA sequence and shows template concatemerization.

Sequences:

P312
ACACTCTTTCCCTACACGACGCT
Right adaptor

P313
/5Phos/GCGTCGTGTAGGGAAAGAGTGT
Right adaptor

P314
/5Phos/CACTCTTTCCCTACACGACGCT
Left adaptor

P315
AGCGTCGTGTAGGGAAAGAGTGT
Left adaptor

P316
ACACTTTATGCTTCCGGCTC
Amp pUC18 for 200bp frag with KpnI in middle

-continued

P317
TAAGTTGGGTAACGCCAGG
Amp pUC18 for 200bp frag with KpnI in middle

P318
ACACTCTTTCC
Invasion primers

P319
AGCGTCGTG
Invasion primers

P320
TTCCAATGATACGGCGACCACCGAUACUGUCAUAG
CTAGCTCCT
Outside adaptor - can use P5 primer USER compatible P321
/5Phos/GGAGCTAGCTATGACAGTATCGGTGGTCGCC
GTATCATTACTT
Outside adaptor - can use P5 primer

Example 14: Improved Conversion Efficiency (RNA Sample to Next-Generation Sequence (NGS) Library) after 3'-phosphate, 2'-phosphate and 2',3'-cyclic phosphate removal Some of the proposed or demonstrated techniques of the present disclosure require free 3'-hydroxyl at the 3'-end of an RNA sample. For example, 3'-OH is required for RNA poly(A) tailing with a polymerase (e.g., poly-A polymerase), and/or for DNA poly-tailing with terminal deoxynucleotidyl transferase (TdT), and/or for ligation. Endogenous RNA usually contains a 3'-hydroxyl or a 2',3'-cyclic phosphate or a 3'-phosphate. The 3'-hydroxyl can be a product of transcription, poly(A) tail synthesis, or enzymatic cleavage (enzymes with catalytic mechanism similar to RNase H). The 2',3'-cyclic phosphate can be a product of enzymatic cleavage (enzymes like RNase A) or spontaneous hydrolysis (non-enzymatic intramolecular transphosphorylation). For example, RNA can be cleaved by intramolecular transesterification.

The 2',3'-cyclic phosphate is very common due to natural RNA phosphodiester bond instability and can occur naturally (cell free RNA degradation) or as a result of sample treatment or storage. RNA samples bearing 2',3'-cyclic phosphate or 3'-phosphate cannot be subsequently poly-tailed or ligated because the presence of a free 3'-hydroxyl group is required for both. For this reason, RNA samples with 2',3'-cyclic phosphate or 3'-phosphate can be treated with a phosphatase (e.g., T4 polynucleotide kinase (PNK) enzyme) to generate a 3'-hydroxyl group. Other examples of phosphatases are disclosed in TABLE 13 below (Ushati Das and Stewart Shuman, Mechanism of RNA 2',3'-cyclic phosphate end healing by T4 polynucleotide kinase-phosphatase, Nucleic Acids Research, 2013, vol. 41, No. 1, 355-365).

TABLE 13

Comparison of RNA repair enzymes that heal 2',3'-cyclic phosphate ends

| Enzyme | Family | Metal | End-product | CPDase product | y-Pase | Z-Pase |
|---|---|---|---|---|---|---|
| T4 Pakp | Acylphosphatase | $Mg^{2+}$ | 3'-OH, 2'-OH | 3'-$PO_4$, 2'-OH | Yes | Yes |
| C24 Pakp | Binuclear metallophosphoesterase | $Mn^{2+}$ $Ni^{2+}$ | 3'-OH, 2'-OH | 3'-OH, 2'-$PO_4$ | Yes | Yes |
| Yeast and plant tRNA bigase | 2H phosphoesterase | None | 3'-OH, 2'-$PO_4$ | 3'-OH, 2'-$PO_4$ | No | No |
| RtcB | RtcB | $Mn^{2+}$ | 3'-$PO_4$, 2'-OH | 3'-$PO_4$, 2'-OH | No | ? |

T4 polynucleotide kinase (PNK) enzyme includes both kinase and phosphatase enzymatic activities. Thus, to optimize the T4 PNK, the kinase enzymatic activity can be removed by substituting at least one of the catalytically essential amino acids. This results in the phosphatase being the only enzymatic activity present. Removing the kinase activity helps with subsequent reactions such as poly-A tailing using ATP for example, because ATP is also a kinase substrate. Examples of cell free RNA NGS library preparation protocols including de-phosphorylation are disclosed herein. Also disclosed herein are comparison reactions (e.g., reactions not treated with T4 PNK). The results showed a significant 3 to 5-fold increase in the number of RNA particles captured in the NGS library (refer to bio-analyzer trace data in FIG. 26).

Additional potential benefits: the unique properties of the 3'end of RNA particles depending on the type of process used to generate the RNA particles, allow one to focus and/or manipulate the sequencing library. For example, if one does not wish to sequence RNA fragments generated due to process degradation (e.g., incomplete RNA fragments bearing 2',3'-cyclic phosphate), one can avoid treating the sample with T4 PNK. In this way, the library will include full mRNAs and miRNAs (3'-hydroxyl).

Example 15: RNA Sample Fragmentation is Part of the NGS Library Preparation Workflow; Enzymatic and Nonenzymatic Methods (Relevant for Short-Read Technologies Like Illumina and Ion Torrent)

Figure 26:
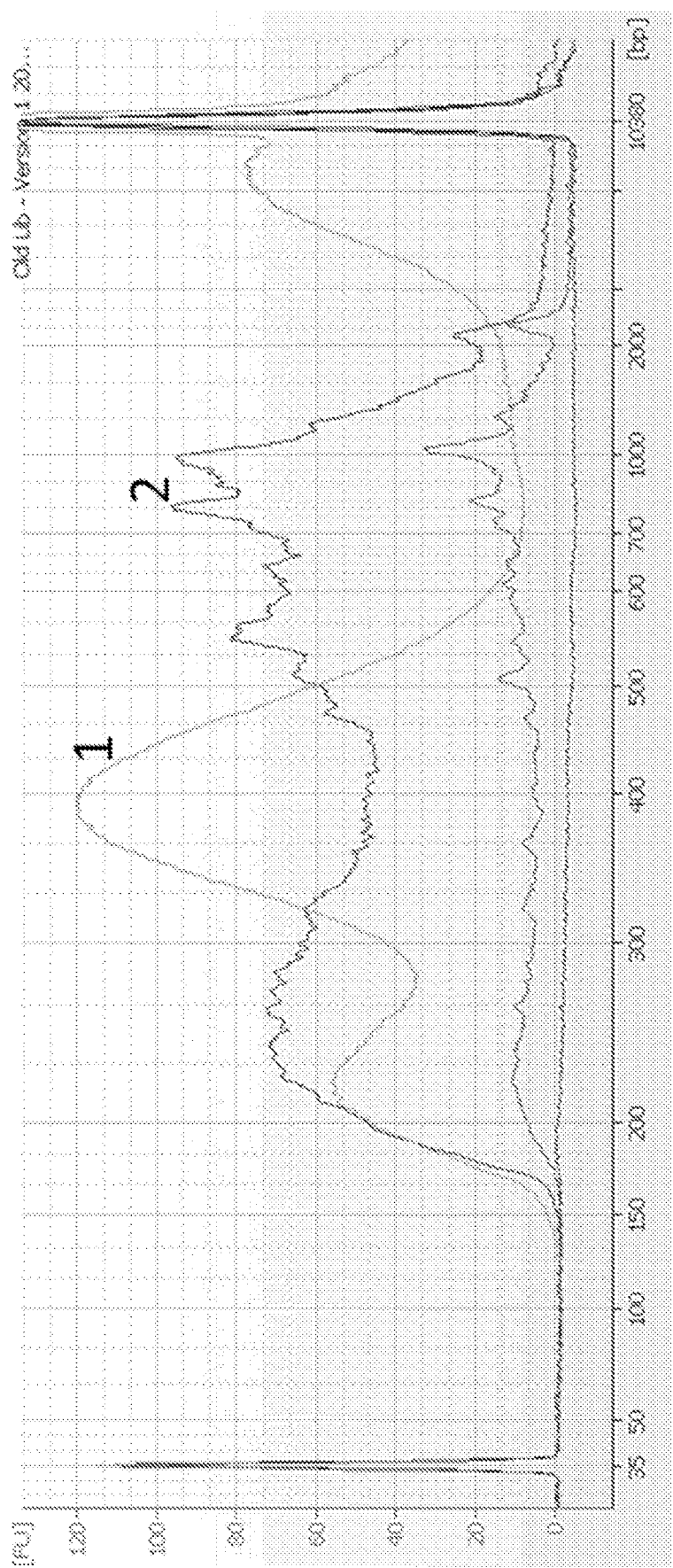
FIG. 26 illustrates a BioAnalyzer trace data of Next-Generation Sequencing (NGS) libraries. Line 1 represents a fragmented RNA seq library from plasma and line 2 represents a no-fragmented RNA seq library from plasma (see, Example 15)

Major DNA sequencing technologies, such as illumina or ion torrent, are limited in regards to sequencing read-length (meaning that a limited number of bases can be sequenced in each individual read). Both technologies have a read range of up to about 100 bp-500 bp, making it impractical to use a library that significantly exceeds this range. Cell free RNA usually ranges from about 20 to 2000 bases, formalin-fixed paraffin-embedded (FFPE) RNA ranges from about 20 to 500 bases and mRNA is usually around 2000 bases. For practical reasons, samples are usually fragmented, so effective library size is no more than 400 bp. Sample loading library fragments longer than 1000 bp is very inefficient compared to shorter fragments. Disclosed herein are two general methods of RNA sample fragmentation: enzymatic and non-enzymatic. The enzymatic method can use enzymes with RNase activity (e.g., RNase A, RNase P, RNase H, RNase III, RNase T, RNase T2, RNase U2, RNase V, RNase I, RNase L, RNase PhyM, RNase V, dicer, or argonaute). The non-enzymatic method disclosed herein takes advantage of the natural chemical instability of RNAs. RNA can undergo spontaneous non-enzymatic fragmentation as a result of internal transphosphorylation. Breaking of phosphodiester bonds of RNA can be brought about by various conditions (e.g., metals, such as Mg, Mn, Pb, or polyamines, or cofactors, such as PVP or PEG). An increase in the transphosphorylation rate can be achieved, for example, with high pH or with high(er) temperature. Non-enzymatic hydrolysis preferentially happens in single stranded portions of RNA particles, preferentially between bases UA or CA. The advantages of using a non-enzymatic method includes: simplicity and reliability (independent of enzyme activity or shelf life), and the fact that the reaction can be conducted in conditions compatible with the majority of the subsequent steps. TABLE 16 below shows a workflow of both a fragmentation protocol and a no-fragmentation protocol. FIG. 26 shows the bioanalyzer trace data for the fragmentation protocol (represented by line 1) and the no-fragmentation protocol (represented by line 2). The libraries were prepared using cell free RNA sample.

TABLE 16

Workflow

| | No Fragmentation | | With Fragmentation |
|---|---|---|---|
| Work flow: | | STEP_1 | RNA fragmentation by heat treatment |
| STEP_1 | PNK Treatment | STEP_2 | PNK Treatment |
| STEP_2 | Poly Adenylation using Poly-A Polymerase | STEP_3 | Poly Adenylation using Poly-A Polymerase |
| STEP_3 | Poly T Primer annealing | STEP_4 | Poly T Primer annealing |
| STEP_4 | 2D-RT & Tagging reaction | STEP_5 | 2D-RT & Tagging reaction |
| STEP_5 | primer-adapter excess and non-specific priming product cleaning with Magnetic beads with immobilized oligoA | STEP_6 | primer-adapter excess and non-specific priming product cleaning with Magnetic beads with immobilized oligoA |
| STEP_6 | SPRI cleanup | STEP_7 | SPRI cleanup |
| STEP_7 | Sample Index PCR | STEP_8 | Sample Index PCR |
| STEP_8 | SPRI cleanup | STEP_9 | SPRI cleanup |

In short, the no-fragmentation protocol included 6.5 µL of $H_2O$, 2 µL of 10× T4 PNK buffer, 0.5 µL of 10× RNase inhibitor, 1 µL of 10 U/µL T4 PNK enzyme, and 10 µL sample (e.g., cell free RNA sample). The reaction was incubated at 37° C. for 20 minutes, 70° C. for 4 minutes, and then placed on ice. 3.25 µL of $H_2O$, 10 µL of 5×2D PNK buffer, 1.25 µL of 10× RNase inhibitor, 7.5 µL of 10 mM ATP, and 1.25 µL of 5 U/µL E. coli PolyA Pol were then added to the reaction. The reaction was incubated at 16° C. for 5 minutes and then placed on ice. 0.5 µL of 100× dNTPs, 1 µL of 10 µM P334 Primer, 0.25 µL of 100 µM P423 DNA ter acc were then added to the reaction. The reaction was incubated at 70° C. for 2 minutes, and then placed on ice for 2 minutes. 1.25 µL of 10× RNase inhibitor, 3.75 µL of P2 (e.g., R2 variant at 1 µg/µL (e.g., an R2 RT N-truncation, such as SEQ ID NO: 50)) were added to the reaction (for a total of 50 µL reaction). The reaction was incubated at 34° C. for 1 hour, pulled down, spri 1.6×, then eluted in 50 µL. See FIG. 26, line 2. In some instances, a reverse transcriptase or a modified reverse transcriptase, or an enzyme that has similar function to a reverse transcriptase can be used instead of P2.

In short, the fragmentation protocol included 1 µL of 10× buffer A and 9 µL of sample (e.g., cell free RNA sample). The reaction was incubated at 94° C. for 4 minutes and then placed on ice. 14.75 µL of $H_2O$, 3 µL of 10× buffer B, 0.75 µL of 10× RNase inhibitor, and 1.5 µL of 10 U/µL T4 PNK enzyme were added to the reaction. The reaction was incubated at 37° C. for 30 minutes, at 72° C. for 3 minutes and then placed on ice. 5 µL of 10× buffer C, 1.25 µL of 10× RNase inhibitor, 7.5 µL of 10 mM ATP, and 1.25 µL of 5 U/µL E. coli PolyA Pol were then added to the reaction. The reaction was incubated at 16° C. for 5 minutes and then placed on ice. 0.5 µL of 100× dNTPs, 1 µL of 10 µM P334 Primer, 0.25 µL of 100 µM P423 DNA ter acc were then added to the reaction. The reaction was incubated at 70° C. for 2 minutes, and then placed on ice for 2 minutes. 1.25 µL of 10× RNase inhibitor and 3.75 µL of P2 (e.g., R2 variant at 1 µg/µL (e.g., an R2 RT N-truncation, such as SEQ ID NO: 50)) (were added to the reaction (for a total of 50 µL reaction). The reaction was incubated at 34° C. for 1 hour, pulled down, spri 1.6×, then eluted in 50 µL. See FIG. 26, line 1. In some instances, a reverse transcriptase or a modified reverse transcriptase, or an enzyme that has similar function to a reverse transcriptase can be used instead of P2.

In short, the 5×2D PNK buffer included 645 µL of $H_2O$, 10 µL of 1000 mM Tris-HCl pH 7.5, 300 µL of 5000 mM $NaCl_2$, 5 µL of 1000 mM $MgCl_2$, 25 µL of 10% tween, and 15 µL of 1000 mM DTT. The buffer A stock included 60 µL of $H_2O$, 10 µL of 1000 mM Tris-HCl pH 8.3, and 30 µL of 1000 mM $MgCl_2$. The buffer B stock included 45 µL of $H_2O$, 50 µL of 1000 mM Tris-HCl pH 7.5, and 5 µL of 1000 mM DTT. The buffer C stock included 36 µL of $H_2O$, 60 µL of 5000 mM $NaCl_2$, 2.5 µL of 10% tween, and 1.5 µL of 1000 mM DTT. The 10×PNK buffer included 150 µL of $H_2O$, 700 µL of 1000 mM Tris-HCl pH 7.5, 100 µL of $MgCl_2$, and 50 µL of 1000 mM DTT. The 100× balanced dNTPs included 100 µL of $H_2O$, 75 µL of 100 mM dATP, 75 µL of 100 mM of dTTP, 375 µL of 100 mM dGTP, and 375 µL of 100 mM dCTP. The 5× R2 buffer+dNTPs included 430 µL of $H_2O$, 150 µL of 1000 mM Tris-HCl pH 7.5, 300 µL of 5000 mM $NaCl_2$, 25 µL of 1000 mM $MgCl_2$, 25 µL of 10% tween, 25 µL of 1000 mM DTT, 3.75 µL of 100 mM dATP, 3.75 µL of 100 mM of dTTP, 18.75 µL of 100 mM dGTP, and 18.75 µL of 100 mM dCTP. The streptavidin magnetic beads included 160 µL of streptavidin magnetic beads (NEB) saturated with biotinylated oligo AAAAAAAAAAAAAAAAAAAAAAAAAAAAAA AAAAAA/3BioTEG/; beads were resuspended in 10 mM Tris pH7.5, 300 mM $NaCl_2$. The primer sequences used were:

P334
(A/iSp9/CCGTGACTGGAGTTCAGACGTGTGCTCTTCCGATCTNNNNN

NNNTTTTTTTTTTTTTTTT);

P423
(AA/iSp9/ACACTCTTTCCCTACACGACGCTCTTCCGATCT/3ddC/);

P399
(AATGATACGGCGACCACCGAGATCTACACGTACTGACACACTCTTT

CCCTACACGACGC);

P400
(CAAGCAGAAGACGGCATACGAGATATTACTCGGTGACTGGAGTTCAGA

CGTGT)

Example 16: Robust Mechanism of R2 RT Jumping

R2 RT jumping is a very efficient mechanism. It is much less sensitive to the acceptor-adapter sequences compared to template switching mechanisms (e.g., methods that use MMLV). This low sensitivity allows for optimal utilization of sequencing adapters in the Illumina sequencing for example. In this experiment, a variety of acceptors were tested. The results showed similar efficiency between RNA and DNA acceptors. The use of DNA acceptors allow for cheaper and more reliable and/or stable technology. The results also showed that the conversion efficiency was not sensitive to the 3'-end of the acceptor sequences. Thus, this mechanism allows for flexibility regarding acceptor sequences and it is relevant for both RNA and DNA samples. Examples of acceptors used:

1)
AA/iSp9/ACACTCTTTCCCTACACGACGCTCTTCCGATCTAGGG/

3ddC/;

2)
AA/iSp9/ACACTCTTTCCCTACACGACGCTCTTCCGATCTCAGGG/

3ddC/;

3)
AA/iSp9/ACACTCTTTCCCTACACGACGCTCTTCCGATCTTCTGGG/

3ddC/;

4)
AA/iSp9/ACACTCTTTCCCTACACGACGCTCTTCCGATCTG/3ddC/;

5)
AA/iSp9/ACACTCTTTCCCTACACGACGCTCTTCCGATCT/3ddC/;

6)
AA/iSp9/ACACTCTTTCCCTACACGACGCTCTTCCGATCTrGrGrG/

3ddC/;

7)
AAAA/iSp9/ACACTCTTTCCCTACACGACGCTCTTCCGATCTrGrGrG;

8)
AA/iSp9/ACACTCTTTCCCTACACGACGCTCTTCCGATCTN/3ddC/;

9)
AA/iSp9/ACACTCTTTCCCTACACGACGCTCTTCCGATCTNN/3ddC/;

10)
AA/iSp9/ACACTCTTTCCCTACACGACGCTCTTCCGATCT*/3ddC/;

11)
AA/iSp9/ACACTCTTTCCCTACACGACGCTCTTCCGATCTN/ ideoxyI//3ddC/;

12)
AA/iSp9/ACACTCTTTCCCTACACGACGCTCTTCCGATC/iSuperdT//3ddC/;

and

13)
A/iSp9/CCGTGACTGGAGTTCAGACGTGTGCTCTTCCGATCT/3ddC/.

Example 17: Poly-A Tail Length Control, Method with Non-Extendable Nucleotide Poly A polymerase is an RNA polymerase used frequently to generate a poly-A tail on the 3' end of an RNA (e.g., poly-A polymerase form E. coli or yeast). Poly-A polymerase has enzymatic activity that allows for the generation of an RNA chain (i.e., extension of the 3'end of an RNA) without an RNA or DNA template. Although, poly-A polymerase preferably synthesizes a poly-A tail, poly-A polymerase also has activity with other ribonucleotides (e.g., CTP, GTP and UTP). Controlling the poly-A tail length is important for sequencing quality and yield. Typically. ATP concentration and reaction time and/or temperature are used to control the poly-A tail length. Alternative methods can be used, such as using a blocking (un-extendable) nucleotide (e.g., 3'-Deoxyadenosine-5'-Triphosphate (an ATP analog)). Once a blocking nucleotide, 3'-Deoxyadenosine-5'-Triphosphate, is incorporated to an RNA chain analog, it cannot be further extended due to a lack of a 3' hydroxyl group. Various concentrations of ATP and 3'-Deoxyadenosine-5'-Triphosphate were used. It was found that the poly-A tail length could be controlled based on the concentration/ratio of ATP and 3'-Deoxyadenosine-5'-Triphosphate, which was independent of reaction time and/or enzyme concentration. This method provides for significant protocol advantage when applied to high throughput or automated processes.

Example 18: Methods of Generating cfDNA Library

Described herein are two methods of generating cfDNA libraries. To help explain both methods, the protocol was divided into two general steps. In the first step, an R2 enzyme (2D Genomics R2 enzyme and derivatives) and accessory enzymes were used. The product of this step includes double stranded DNA (dsDNA), such as one original sample strand flanked by attached adapters with known sequences. This dsDNA particle includes one original sample strand and one which is copied by R2 and accessory enzymes. The copy strand includes degradable nucleotides, such as dUTP, which can be degraded upon treatment with Uracil-DNA Glycosylase (UDG) enzyme, for example. An alternative method to remove the copy strand includes having dUTPs in the primer-adapter sequence or using a nonsymmetrical adapter. In the second step, the original DNA strand with attached adapters is PCR amplified using high fidelity methods/enzymes (for example enzymes with proofread activity). At least one advantage of retaining the original strand for sequencing is that it avoids introducing errors while copying it using a non-error correcting enzyme such as an R2 enzyme. Hence, the resulting library is not compromised for fidelity.

Figure 27:
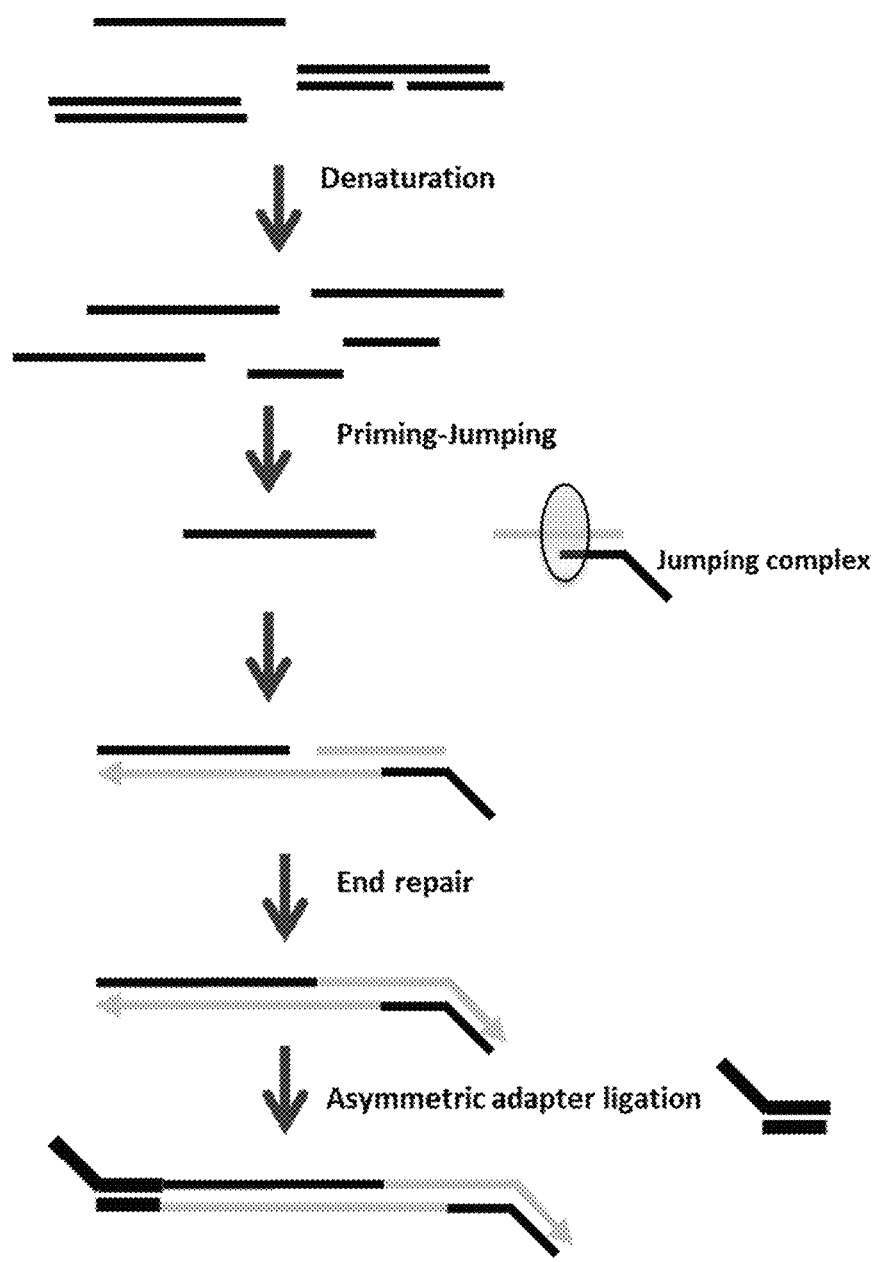
FIG. 27 and FIG. 28 illustrate methods of generating cell free deoxyribonucleic acid (cfDNA) library.

Method 1 (see, FIG. 27): First, cell free DNA (cfDNA) is denatured to produce a single-stranded DNA (ssDNA) sample. This allows for each strand to be analyzed separately compared to ligation based methods (both strands in one final product). Analyzing each strand separately creates more opportunities to capture rare mutations. The protocol can also include a dephosphorylation step (3' and 5' ends). Next, ssDNA is mixed with a priming-jumping complex including DNA or RNA adapter with annealed primer and R2 polymerase. The reaction includes dNTPs and catalytic metals. In short, R2 first extends the primer on the adapter template and then template-jumps to the ssDNA sample. The generated product is dsDNA with one nick between the adapter template and the ssDNA sample. The next step is end repair with a DNA polymerase that has 3'-to-5' exonuclease activity (e.g., T4 pol, Klenov fragment, Bst DNA polymerase or Phi29 DNA pol). The polymerase may also posses DNA strand displacement capability. The resulting product is a dsDNA with blunt ends or 3' A-overhang. The nick may be replaced with a whole new strand where extension and displacement is primed by the 3' hydroxyl of the original sample strand. On the other hand, the nick can be repaired during the next step ligation. Next step ligation includes an asymmetric adapter. Adapter is a DNA duplex with one single-stranded overhang at the 5'end. This overhang includes a sequence complementary to at least one of the PCR amplification primers, causing only one strand to be amplified. Alternatively, in order to isolate only the original ssDNA strand, an adapter with both 3' and 5' overhangs can be used (Y-structure) in combination with dUTP and UDG degradation. PCR amplification is then performed and includes DNA primers that are specific to both adapters. Only one of the strands from the previous steps is amplified: the one including the original sample DNA. In some embodiments, isolation of the original ssDNA strand occurs between the end repair and the asymmetric adapter ligation steps.

Figure 28:
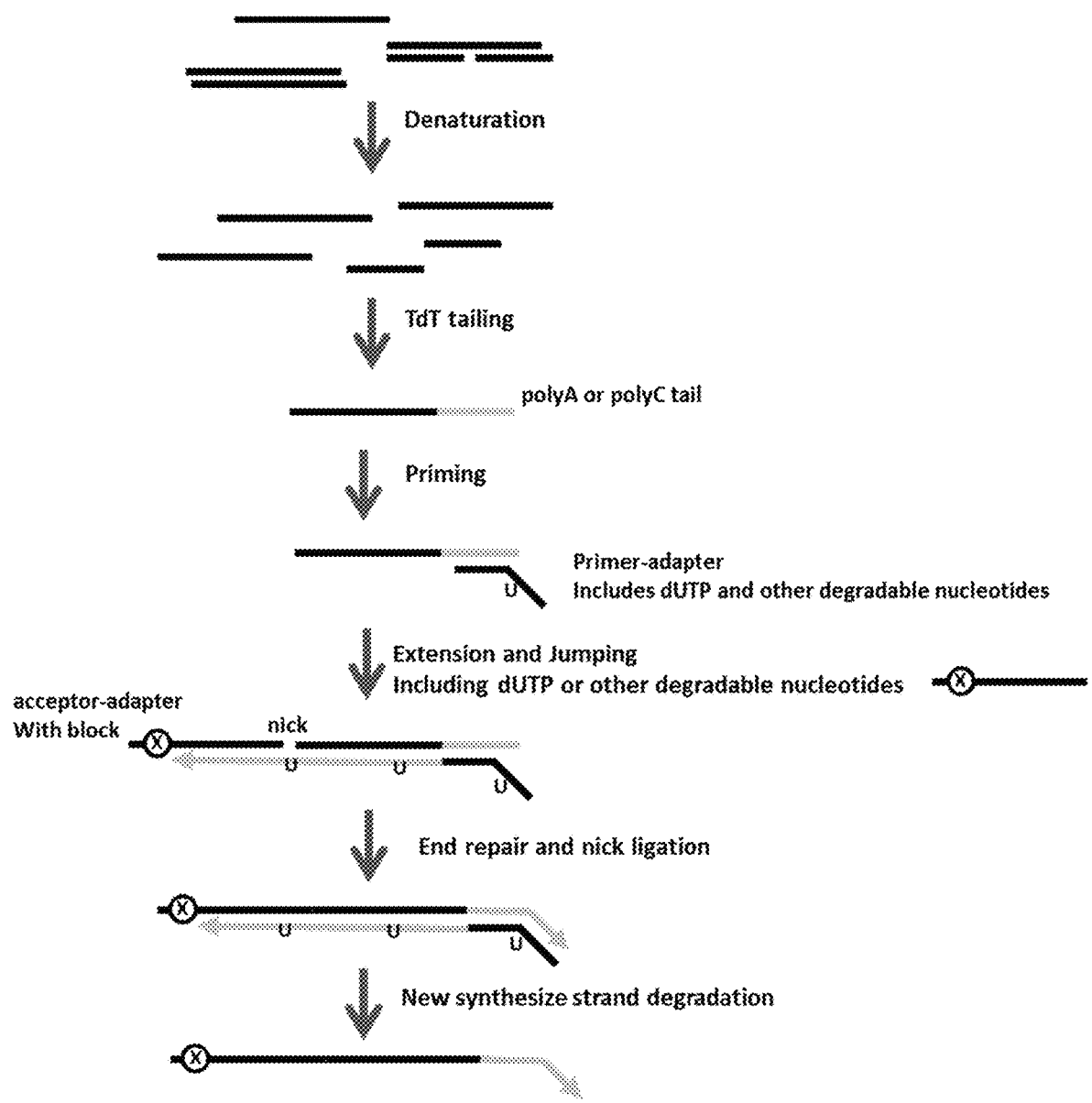

Method 2 (see. FIG. 28): First, cell free DNA (cfDNA) is denatured to produce single-stranded DNA (ssDNA) sample. The protocol can also include a dephosphorylation step (3' and 5' ends). Next, a polyA or polyC tail is generated by, for example, the addition of terminal deoxynucleotidyl transferase (TdT). The length of the TdT generated tail can be controlled based on the combination of dATP and incubation time or temperature (if polyA tailing was selected). Alternatively, the length of the polyA tail can be controlled based on non-extendable nucleotides (e.g., ddATP or 3'-Deoxyadenosine-5'-Triphosphate). Here, the reaction includes both dATP and a non-extendable analog that were used at various ratio and concentrations. Next, TdT can be temperature killed and the sample can be annealed with a primer-adapter complementary to the DNA tail sequence. The reaction is then mixed with dNTPs (including dUTP), catalytic metal, R2 enzyme, and acceptor-adapter. The R2 enzyme extends the annealed primer and jumps to the acceptor-adapter to continue extending. The acceptor-adapter includes a nucleotide block to prevent R2 from finishing the template and jumping to another template. The product is a double-stranded DNA with 5' overhangs on both sides and a nick between a cfDNA sample strand and the acceptor-adapter. The product is then subject to end repair and nick ligation with a DNA polymerase having 3'-to-5' exonucleolytic activity and a DNA ligase (e.g., T4 pol, Klenov fragment, Bst DNA polymerase or Phi29 DNA pol, T4 DNA Ligase). The product of the end repair and nick ligation is then subject to UDG degradation. The last step is PCR amplification which includes DNA primers specific to both adapters. Only one of the strands from the previous steps is amplified; the one including the original sample DNA.

Example 19: Library Preparation, Depletion of Ribosomal RNA (rRNA) and Transfer RNA (tRNA) to Maximize Sequencing Throughput Approximately 80% of the total RNA in cells is rRNA and 15% is tRNA. Ribosomal RNA rarely serves as a diagnostic target. Therefore, because of that, the practice is to remove/deplete rRNA and tRNA from sequencing libraries. The amount of rRNA and tRNA in sequencing libraries can be controlled at various stages of library preparation. For example, depletion of rRNA and tRNA can occur during the early stages, e.g., after total RNA isolation (RNA level), or after PCR amplification (dsDNA level). Two general methods to remove rRNA and tRNA is described herein: 1) pulling rRNA/tRNA or PCR products using complementary oligonucleotide attached to magnetic beads or solid support, and 2) oligonucleotide-guided degradation of the rRNA/tRNA or PCR products.

Figure 29:
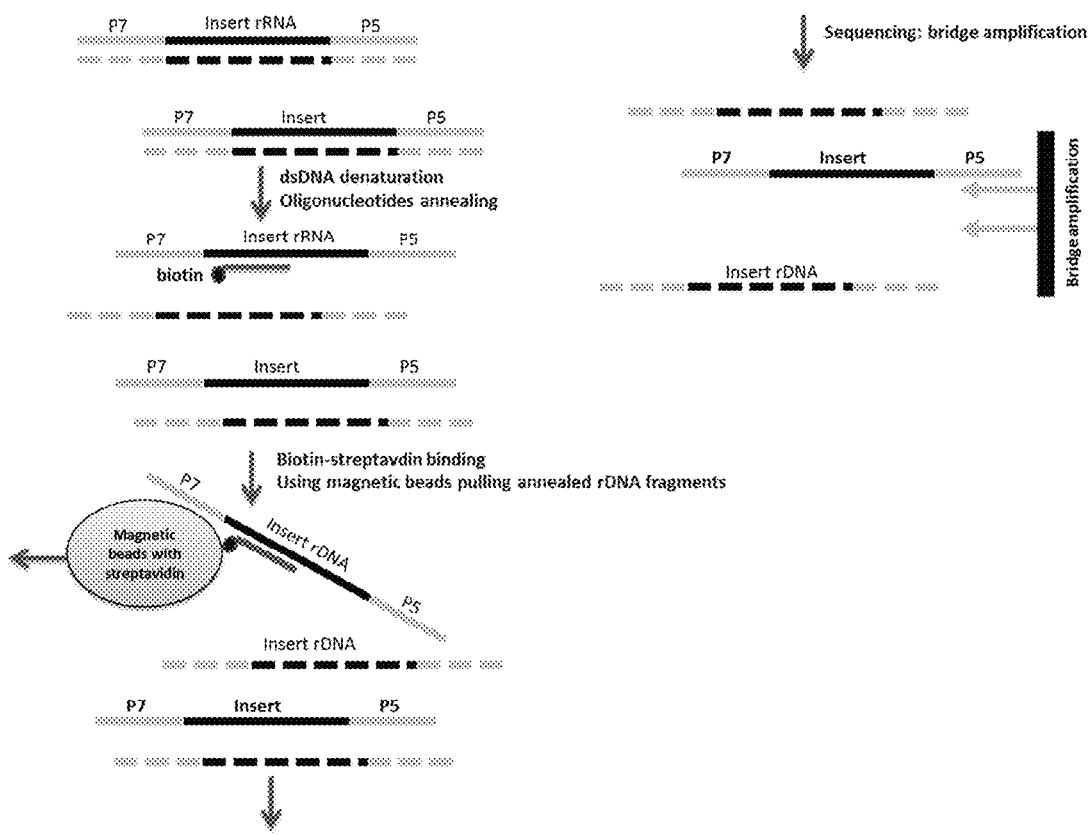
FIG. 29 illustrates library preparation: pulling ribosomal RNA and/or transfer RNA and/or PCR products using complementary oligonucleotide attached to magnetic beads or solid support to maximize sequencing capacity.

Method 1: In this method, amplified dsDNA is denatured and hybridized to a pool of strategically designed oligonucleotides. Oligonucleotides are complementary to one or both DNA strands with rDNA sequence. For Illumina library, only one strand may be depleted as only one polarity is used in bridge amplification (see, FIG. 29). Each oligonucleotide includes biotin modification. Ribosomal sequences (including DNA fragments) are depleted/removed using straptvidin-immobilized magnetic beads or solid support. In some cases, depletion is performed after PCR library amplification in order to mitigate losses of rare and low represented sequences. Depletion can also be performed during the early stages of library preparation (e.g., RNA level).

Figure 30:
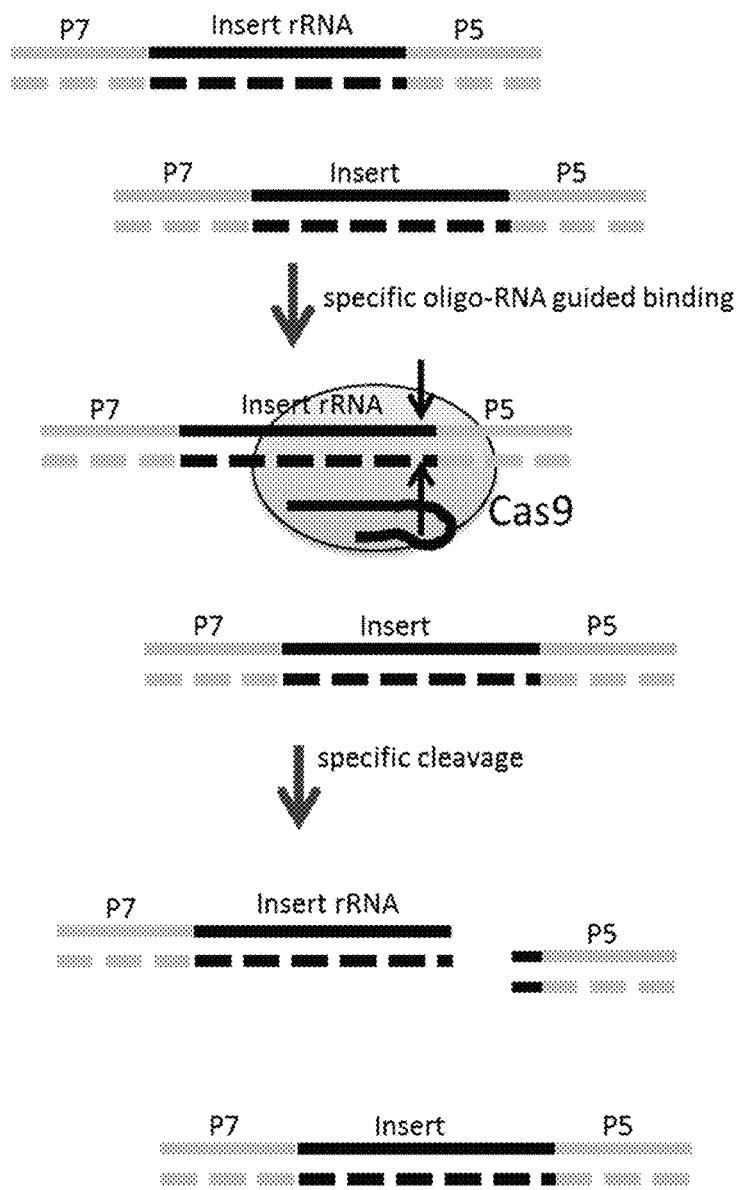
FIG. 30 illustrates library preparation: oligonucleotide-guided degradation of ribosomal RNA and/or transfer RNA and/or PCR products to maximize sequencing capacity.
Figure 31:
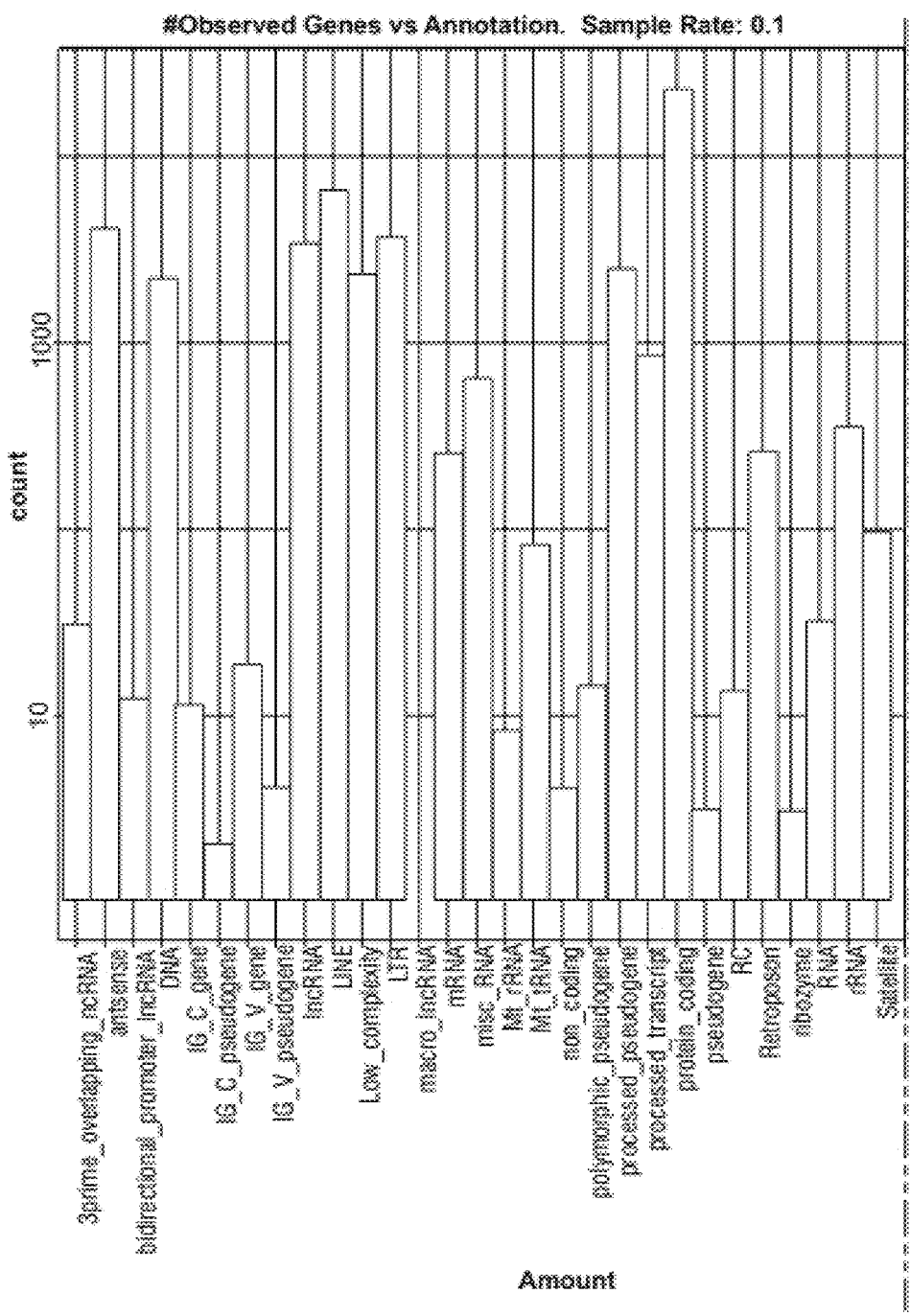
FIG. 31 illustrates a technology of the present disclosure that is capable of capturing/targeting all species of RNA simultaneously.
Figure 31:
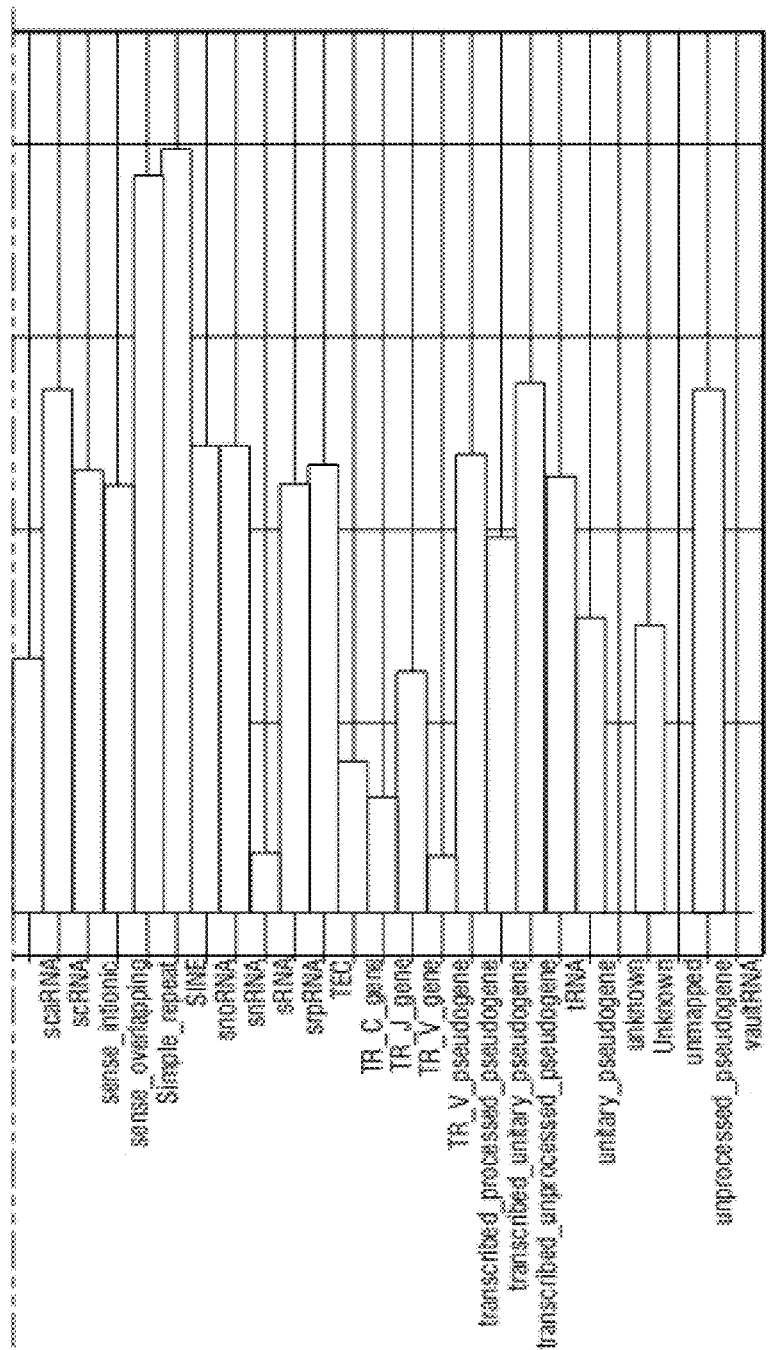

Method 2: In this method, Cas9 nuclease is complexed with strategically designed guiding RNA oligonucleotides (Carolin Anders and Martin Jinek, In vitro Enzymology of Cas9, Methods Enzymol., 2014; 546: 1-20). Oligonucleotides can have sequences complementary to ribosomal RNA. Complexes of Cas9 with guiding RNA oligonucleotide specifically binds dsDNA (after PCR amplification) and rRNA sequences, and catalyzes endonucleolitic cleavage of single or both DNA strands (see, FIG. 30).

Embodiments

Embodiment 1. A method for preparing a complementary deoxyribonucleic acid (cDNA) molecule using template jumping, comprising: annealing a primer to a template, and mixing, in the presence of nucleotides, the template annealed to the primer with a modified reverse transcriptase and an acceptor nucleic acid molecule under conditions sufficient to generate a continuous cDNA molecule complementary to the template and to the acceptor nucleic acid molecule, wherein the modified reverse transcriptase comprises at least one improved enzyme property relative to a wild type or unmodified reverse transcriptase, wherein upon producing the continuous cDNA molecule, the modified reverse transcriptase undergoes migration from the template to the acceptor nucleic acid molecule.

Embodiment 2. A method for preparing a complementary deoxyribonucleic acid (cDNA) molecule using template jumping, comprising: (a) annealing one or more primer(s) to a template; and (b) mixing, in the presence of nucleotides, the template annealed to one or more primer(s) with a modified reverse transcriptase and an acceptor nucleic acid molecule under conditions sufficient to generate a cDNA molecule complementary to the template and/or to the acceptor nucleic acid molecule, wherein the modified reverse transcriptase comprises at least one improved enzyme property relative to a wild type or unmodified reverse transcriptase.

Embodiment 3. A method for preparing a nucleic acid molecule using template jumping comprising: mixing, in the presence of nucleotides, a fragment or degraded template, a primer, a modified reverse transcriptase, and an acceptor nucleic acid molecule under conditions sufficient to generate a nucleic acid molecule, wherein the modified reverse transcriptase comprises at least one improved enzyme property relative to a wild type or unmodified reverse transcriptase.

Embodiment 4. A method for preparing a nucleic acid molecule using template jumping comprising: mixing, in the presence of nucleotides, a fragment or degraded template, a donor complex, a modified reverse transcriptase, and an acceptor nucleic acid molecule under conditions sufficient to generate a nucleic acid molecule, wherein the modified reverse transcriptase comprises at least one improved enzyme property relative to a wild type or unmodified reverse transcriptase.

Embodiment 5. A method for preparing a complementary deoxyribonucleic acid (cDNA) library using template jumping, the method comprising: (a) annealing one or more primer(s) to a template; (b) mixing, in the presence of nucleotides, the template annealed to one or more primer(s) with an acceptor nucleic acid molecule and a modified reverse transcriptase, under conditions sufficient to generate a continuous cDNA molecule complementary to the template and/or to the acceptor nucleic acid molecule, wherein the modified reverse transcriptase comprises at least one improved enzyme property relative to a wild type or unmodified reverse transcriptase, wherein upon producing the continuous cDNA molecule, the modified reverse transcriptase undergoes migration from the template to the acceptor nucleic acid molecule; and (c) amplifying the cDNA molecule to generate a cDNA library.

Embodiment 6. A method for preparing a complementary deoxyribonucleic acid (cDNA) library using template jumping, the method comprising: (a) mixing, in the presence of nucleotides, a fragmented or degraded template with a primer, a modified reverse transcriptase, and an acceptor nucleic acid molecule under conditions sufficient to generate a cDNA molecule, wherein the modified reverse transcriptase comprises at least one improved enzyme property relative to a wild type or unmodified reverse transcriptase; and (b) amplifying the cDNA molecule to generate a cDNA library.

Embodiment 7. A method for preparing a deoxyribonucleic acid (DNA) library using template jumping, the method comprising: (a) mixing a fragmented or degraded template with a primer, a modified reverse transcriptase, and an acceptor nucleic acid molecule under conditions sufficient to generate a DNA molecule, wherein the modified reverse transcriptase comprises at least one improved enzyme property relative to a wild type or unmodified reverse transcriptase; and (b) amplifying the DNA molecule to generate a DNA library.

Embodiment 8. A method for preparing a complementary deoxyribonucleic acid (cDNA) library using template jumping, the method comprising: (a) mixing a fragmented or degraded template with a donor complex, a modified reverse transcriptase, and an acceptor nucleic acid molecule under conditions sufficient to generate a cDNA molecule, wherein the modified reverse transcriptase comprises at least one improved enzyme property relative to a wild type or unmodified reverse transcriptase; and (b) amplifying the cDNA molecule to generate a cDNA library.

Embodiment 9. A method for preparing a deoxyribonucleic acid (DNA) library using template jumping, the method comprising: (a) mixing a fragmented or degraded template with a donor complex, a modified reverse transcriptase, and an acceptor nucleic acid molecule under conditions sufficient to generate a DNA molecule, wherein the modified reverse transcriptase comprises at least one improved enzyme property relative to a wild type or unmodified reverse transcriptase; and (b) amplifying the DNA molecule to generate a DNA library.

Embodiment 10. A method for preparing a library for sequencing comprising: (a) obtaining a sample with cell-free nucleic acid from a subject; (b) mixing a modified reverse transcriptase enzyme, a template, nucleotides, an acceptor nucleic acid molecule, and one or more primer(s) to the cell-free nucleic acid, wherein the modified reverse transcriptase is capable of template jumping and comprises at least one improved enzyme property relative to a wild type or unmodified reverse transcriptase; (c) conducting an amplification reaction on cell-free nucleic acid (cf nucleic acid) derived from the sample to produce a plurality of amplicons, wherein the amplification reaction comprises 35 or fewer amplification cycles; and (d) producing a library for sequencing, the library comprising a plurality of amplicons.

Embodiment 11. A method for preparing a complementary deoxyribonucleic acid (cDNA) library from a plurality of single cells, the method comprising the steps of: (a) releasing nucleic acid from each single cell to provide a plurality of individual nucleic acid samples, wherein the nucleic acid in each individual nucleic acid sample is from a single cell; (b) annealing the nucleic acid template to one or more primer(s); (c) mixing, in the presence of nucleotides, the nucleic acid template annealed to one or more primer(s) with an acceptor nucleic acid molecule and a modified reverse transcriptase under conditions effective for producing a cDNA molecule, wherein the modified reverse transcriptase is capable of template jumping and comprises at least one improved enzyme property relative to a wild type or unmodified reverse transcriptase; and (d) amplifying the cDNA molecule to generate a cDNA library.

Embodiment 12. A method for preparing a deoxyribonucleic acid (DNA) library from a plurality of single cells, the method comprising the steps of: (a) releasing nucleic acid from each single cell to provide a plurality of individual nucleic acid samples, wherein the nucleic acid in each individual nucleic acid sample is from a single cell; (b) annealing the nucleic acid template to one or more primer(s); (c) mixing, in the presence of nucleotides, the nucleic acid template annealed to one or more primer(s) with an acceptor nucleic acid molecule and a modified reverse transcriptase under conditions effective for producing a DNA molecule, wherein the modified reverse transcriptase is capable of template jumping and comprises at least one improved enzyme property relative to a wild type or unmodified reverse transcriptase; and (d) amplifying the DNA molecule to generate a DNA library.

Embodiment 13. A method for detecting a nucleic acid molecule, the method comprising the steps of: (a) mixing a sample comprising a nucleic acid molecule with an acceptor nucleic acid molecule, a modified reverse transcriptase, a primer, and nucleotides, under conditions effective for generating a nucleic acid molecule, wherein the modified reverse transcriptase comprises at least one improved enzyme property relative to a wild type or unmodified reverse transcriptase; and (b) amplifying the nucleic acid molecule.

Embodiment 14. A method for determining the presence of cancer in a subject comprising: (a) obtaining a biological sample from a subject; (b) detecting a nucleic acid molecule in the biological sample of embodiment 13; (c) sequencing the nucleic acid molecule; and (d) determining that the subject is afflicted with cancer based on the presence of the nucleic acid molecule.

Embodiment 15. A method for preparing a complementary deoxyribonucleic acid (cDNA) molecule using template jumping, comprising mixing, in a single tube, a primer or one or more primer(s), a messenger RNA (mRNA) template, nucleotides, a modified reverse transcriptase, an acceptor nucleic acid molecule, and a catalytic metal under conditions sufficient to generate a continuous cDNA molecule complementary to the mRNA template and to the acceptor nucleic acid molecule, wherein the modified reverse transcriptase comprises at least one improved enzyme property relative to a wild type or unmodified reverse transcriptase, wherein upon producing the continuous cDNA molecule, the modified reverse transcriptase undergoes migration from the template to the acceptor nucleic acid molecule.

Embodiment 16. A method for preparing a library for sequencing comprising mixing, in a single tube, a cell-free nucleic acid, a modified reverse transcriptase enzyme, a template, nucleotides, an acceptor nucleic acid molecule, a catalytic metal, and one or more primer(s), under conditions sufficient to generate a library, wherein the modified reverse transcriptase comprises at least one improved enzyme property relative to a wild type or unmodified reverse transcriptase.

Embodiment 17. A method for preparing a library under conditions sufficient to generate a library for sequencing comprising: (a) obtaining a sample with cell-free nucleic acid from a subject; (b) mixing a modified reverse transcriptase, a template, nucleotides, and one or more primer(s) to the cell-free nucleic acid; (c) conducting an amplification reaction on cell-free nucleic acid (cf nucleic acid) derived from a sample to produce a plurality of amplicons, wherein the amplification reaction comprises 35 or fewer amplification cycles; and (d) producing a library for sequencing, the library comprising the plurality of amplicons.

Embodiment 18. A method for preparing a cDNA molecule comprising mixing, in the presence of nucleotides, a primer, a template, a modified reverse transcriptase and an acceptor nucleic acid molecule under conditions sufficient to generate a cDNA molecule complementary to the template and/or to the acceptor nucleic acid molecule, wherein the modified reverse transcriptase comprises at least one improved enzyme property relative to a wild type or unmodified reverse transcriptase.

Embodiment 19. A method for preparing a cDNA molecule comprising mixing, in the presence of nucleotides, one or more primer(s), a template, a modified reverse transcriptase, and an acceptor nucleic acid molecule under conditions sufficient to generate a cDNA molecule complementary to the template and/or to the acceptor nucleic acid molecule, wherein the modified reverse transcriptase comprises at least one improved enzyme property relative to a wild type or unmodified reverse transcriptase.

Embodiment 20. A method for preparing a cDNA library comprising mixing, in the presence of nucleotides, a primer or one or more primer(s), a template, a modified reverse transcriptase, and an acceptor nucleic acid molecule under conditions sufficient to generate a cDNA molecule complementary to the template and/or to the acceptor nucleic acid molecule, wherein the modified reverse transcriptase comprises at least one improved enzyme property relative to a wild type or unmodified reverse transcriptase; and amplifying the cDNA molecule to generate a cDNA library.

Embodiment 21. The method of any one of embodiments 1-20, wherein the nucleic acid molecule (e.g., the acceptor nucleic acid molecule or the cell free nucleic acid molecule) or the template comprises an unknown nucleic acid sequence.

Embodiment 22. The method of any one of embodiments 1, 5, and 15, wherein the migration is independent of sequence identity between the template and the acceptor nucleic acid molecule.

Embodiment 23. The method of any one of embodiments 1-20, wherein the mixing comprises addition of a hot start thermostable polymerase.

Embodiment 24. The method of embodiment 23, wherein the hot start thermostable polymerase is a hot start taq polymerase.

Embodiment 25. The method of any one of embodiments 1-20, wherein the method is performed in a single tube (single vessel).

Embodiment 26. The method of any one of embodiments 1-20, further comprising performing a polymerase chain reaction (PCR) amplification reaction.

Embodiment 27. The method of embodiment 26, wherein the PCR amplification reaction is performed in the same single tube (same vessel) as the single tube (single vessel) of embodiment 25.

Embodiment 28. The method of any one of embodiments 1-16, and 18-20, wherein the acceptor nucleic acid molecule comprises a modified nucleotide that causes primer extension to stop.

Embodiment 29. The method of any one of embodiments 10, 16, and 17, wherein the cell-free nucleic acid is cell-free DNA (cfDNA), circulating tumor DNA (ctDNA), or formalin-fixed, paraffin-embedded DNA (FFPE DNA).

Embodiment 30. The method of embodiment 26, wherein the PCR amplification is performed at a temperature sufficient to inactivate the reverse transcriptase.

Embodiment 31. The method of embodiment 26, wherein the PCR amplification is performed at a temperature sufficient to activate the hot start thermostable polymerase.

Embodiment 32. The method of any one of the embodiments 1-16, and 18-20, wherein the acceptor nucleic acid molecule is modified at the 3' end.

Embodiment 33. The method of embodiment 32, wherein the modification comprises a dideoxy 3' end and/or a phosphorylated 3' end.

Embodiment 34. The method for preparing a nucleic acid molecule and/or library or a complementary cDNA molecule and/or library of any one of embodiments 1-20, wherein the molecule and/or library is prepared in at most about 2 hours.

Embodiment 35. The method of any one of embodiments 10-14 and 17, wherein the sample comprises a circulating tumor DNA sample or a tissue sample.

Embodiment 36. The method of any one of embodiments 1-20, wherein the nucleic acid molecule and/or the acceptor nucleic acid molecule is RNA. DNA, or a combination of RNA and DNA.

Embodiment 37. The method of any one of embodiments 1-12 and 15-20, wherein the template is RNA, DNA, or a combination of RNA and DNA.

Embodiment 38. The method of any one of embodiments 4, 8, and 9, wherein the donor complex comprises a template and a primer.

Embodiment 39. The method of embodiment 37, wherein the template is a fragmented or degraded template.

Embodiment 40. The method of any one of embodiments 36 and 37, wherein the RNA is mRNA.

Embodiment 41. The method of any one of embodiments 1-20, further comprising depleting ribosomal RNA (rRNA) and/or transfer RNA (tRNA).

Embodiment 42. The method of embodiment 41, wherein the step for depleting rRNA comprises hybridization of an oligonucleotide to an rRNA.

Embodiment 43. The method of any one of embodiments 1-20, wherein the nucleic acid and/or the template is from a sample.

Embodiment 44. The method of any one of embodiments 10-14, 17, and 43, wherein the sample is a liquid biopsy sample.

Embodiment 45. The method of any one of embodiments 1-20, wherein the nucleic acid and/or the template is equal to or less than about 0.01 micromolar.

Embodiment 46. The method of embodiment 45, wherein the nucleic acid and/or the template is equal to or less than about 500 femtomolar.

Embodiment 47. The method of any one of embodiments 1-20, wherein the nucleic acid and/or the template is a fragment or a degraded nucleic acid, a fragmented DNA, a fragmented RNA, or any combination thereof.

Embodiment 48. The method of embodiment 13, wherein the nucleic acid molecule is indicative of a disease.

Embodiment 49. The method of embodiment 48, wherein the disease is cancer.

Embodiment 50. The method of any one of embodiments 1-20, further comprising providing a prenatal diagnosis based on the presence or absence of a nucleic acid molecule.

Embodiment 51. The method of any one of embodiments 1-20, further comprising optimization of the template, wherein the optimization comprises contacting a sample comprising the template with an agent that removes the 5' cap structure of the template, under conditions permitting the removal of the cap structure by the agent, thereby forming a decapped template.

Embodiment 52. The method of embodiment 51, further comprising contacting the sample with a dephosphorylating agent under conditions permitting the dephosphorylation of the decapped template by the agent.

Embodiment 53. The method of embodiment 51, wherein the agent is pyrophosphatase.

Embodiment 54. The method of embodiment 52, wherein the agent is alkaline phosphatase.

Embodiment 55. The method of any one of embodiments 1-20, wherein the primer is fluorescently labeled.

Embodiment 56. The method of any one of embodiments 1-20, wherein the reverse transcriptase is a non-long terminal repeat (LTR) retrotransposon (e.g., wherein the modified reverse transcriptase is a non-long terminal repeat (LTR) retrotransposon).

Embodiment 57. The method of any one of embodiments 1-20, wherein the reverse transcriptase is an R2 reverse transcriptase (e.g., wherein the modified reverse transcriptase is a modified R2 reverse transcriptase).

Embodiment 58. The method of embodiment 56, wherein the non-LTR retrotransposon is an R2 non-LTR retrotransposon.

Embodiment 59. The method of any one of embodiments 1-12 and 15, wherein the template jumping is dependent on the concentration of the acceptor nucleic acid molecule.

Embodiment 60. The method of any one of embodiments 1-16 and 18-20, wherein the improved enzyme property comprises at least one of the following: increased stability (e.g., increased thermostability); increased specific activity; increased protein expression; improved purification; improved processivity; improved strand displacement; improved end-to-end template jumping; increased DNA/RNA affinity; and increased fidelity.

Embodiment 61. The method of any one of embodiments 1-20, wherein the modified reverse transcriptase comprises an N-terminal truncation, a C-terminal truncation, or N-terminal and C-terminal truncations.

Embodiment 62. The method of any one of embodiments 1-20, wherein the modified reverse transcriptase comprises a truncation of less than about 500 amino acid residues.

Embodiment 63. The method of any one of embodiments 1-20, wherein the modified reverse transcriptase comprises one or more of the following modifications: (a) an amino-terminal truncation of less than about 400 amino acid residues; and (b) a carboxyl-terminal truncation of less than about 400 amino acid residues.

Embodiment 64. The method of any one of the embodiments 1-20, wherein the modified reverse transcriptase further comprises a tag.

Embodiment 65. The method of any one of embodiments 1, 2, 5, 6, 8, 11, 15, and 18-20, wherein the cDNA molecule further comprises a tag.

Embodiment 66. The method of any one of embodiments 1-12 and 15-20, wherein the template further comprises a tag.

Embodiment 67. The method of any one of embodiments 64-66, further comprising sequencing the modified reverse transcriptase comprising a tag, or the cDNA molecule comprising a tag, or the template comprising a tag.

Embodiment 68. The method of embodiment 67, wherein the sequencing comprises whole transcriptome analysis.

Embodiment 69. The method of any one of embodiments 64-66, wherein the tag is at least one member selected from the group consisting of biotin, azido group, acetylene group, His-tag, Calmodulin-tag, CBP, CYD, Strep II, FLAG-tag, HA-tag, Myc-tag, S-tag, SBP-tag, Softag-1 Softag-3, V5-tag, Xpress-tag, Isopeptag, SpyTag, B, HPC peptide tags, GST, MBP, biotin, biotin carboxyl carrier protein, glutathione-S-transferase-tag, green fluorescent protein-tag, maltose binding protein-tag, Nus-tag, Strep-tag, and thioredoxin-tag.

Embodiment 70. The method of any one of embodiments 1-20, further comprising purifying a solution comprising the continuous cDNA molecule, or the nucleic acid molecule, or the DNA molecule.

Embodiment 71. The method of any one of embodiments 1-20, wherein the method is performed in the absence of purification.

Embodiment 72. The method of any one of embodiments 1-20, wherein the modified reverse transcriptase is derived from an arthropod.

Embodiment 73. The method of embodiment 72, wherein the arthropod is *Bombyx mori*.

Embodiment 74. The method of any one of embodiments 1-20, wherein the modified reverse transcriptase is purified.

Embodiment 75. The method of embodiment 74, wherein the modified reverse transcriptase is at least about 80% pure.

Embodiment 76. The method of embodiment 70, wherein the purifying a solution comprises two purification steps.

Embodiment 77. The method of embodiment 76, wherein the two purification steps comprise a nickel and a heparin affinity purification.

Embodiment 78. The method of embodiment 74, wherein the modified reverse transcriptase is purified by immobilized metal affinity chromatorgraphy (IMAC).

Embodiment 79. The method of any one of embodiments 1-20, wherein the method further comprises a salt.

Embodiment 80. The method of embodiment 79, wherein the salt is at least one member selected from the group consisting of NaCl, LiC, ACl3, CuCl$_2$, MgCl$_2$, InCl$_3$, SnCl$_4$, CrCl$_2$, CrCl$_3$, KCl, NaI, KI, TMACl (tetramethyl ammonium chloride), TEACl (tetraethyl ammonium chloride), KSCN, CsSCN, KCH$_3$COO, CH$_3$COONa, C$_5$H$_8$KNO$_4$, C$_5$H$_8$NNaO$_4$, CsCl, and any combination thereof.

Embodiment 81. The method of embodiment 80, wherein the salt comprises NaCl.

Embodiment 82. The method of any one of embodiments 1-20, wherein the method further comprises a detergent.

Embodiment 83. The method of embodiment 82, wherein the detergent is a non-ionic and/or zwitterionic detergent.

Embodiment 84. The method of embodiment 83, wherein the non-ionic detergent is selected from a group consisting of tween, triton, Triton CF-21, Triton CF-32, Triton DF-12, Triton DF-16, Triton GR-SM, Triton N-101 (Polyoxyethylene branched nonylphenyl ether), Triton QS-15, Triton QS-44, Triton RW-75 (Polyethylene glycol 260 mono-Chexadecyl/octadecyl) ether and 1-Octadecanol), Triton X-100 (Polyethylene glycol tert-octylphenyl ether), Triton X-102, Triton X-15, Triton X-151, Triton X-200, Triton X-207, Triton X-114, Triton X-165, Triton X-305, Triton X-405 (polyoxyethylene(40) isooctylphenyl ether), Triton X405 reduced (polyoxyethylene(40) isooctylcyclohexyl ether), Triton X-45 (Polyethylene glycol 4-tert-octylphenyl ether), Triton X-705-70, TWEEN in any form including: TWEEN 20 (Polyoxyethylene sorbitan monolaurate), TWEEN 21 (Polyoxyethylene sorbitan monolaurate), TWEEN 40 (polyoxyethylene(20) sorbitan monopalmitate), TWEEN 60 (Polyethylene glycol sorbitan monostearate), TWEEN 61 (Polyethylene glycol sorbitan monostearate), TWEEN 65 (Polyoxyethylene sorbitan Tristearate), TWEEN 80 (Polyoxyethylene sorbitan monooleate), TWEEN 81 (Polyoxyethylene sorbitan monooleate), TWEEN 85 (polyoxyethylene(20) sorbitan trioleate), Brij, Brij 30 (Polyoxyethylene 4 lauryl ether) Brij 35 (Polyoxyethylene 23 lauryl ether), Brij 52 (Polyoxyethylene 2 cetyl ether), Brij56 (Polyoxyethylene 10 cetyl ether). Brij 58 (Polyoxyethylene 20 cetyl ether), Brij 72 (Polyoxyethylene 2 stearyl ether), Brij 76 (Polyoxyethylene 10 stearyl ether), Brij 78 (Polyoxyethylene 20 stearyl ether), Brij 92 (Polyoxyethylene 2 oleyl ether), Brij 97 (Polyoxyethylene 10 oleyl ether), Brij 98 (Polyoxyethylene 20 oleyl ether), Brij700 (Polyoxyethylene 100 stearyl ether, octyl thioglucoside, maltosides, and combinations thereof.

Embodiment 85. The method of any one of embodiments 79-84, wherein the salt or the detergent improves enzyme activity or template jumping.

Embodiment 86. The method of any one of embodiments 5-13, 17, and 20, wherein the amplification step comprises PCR.

Embodiment 87. The method of embodiment 86, wherein the PCR comprises at least one amplification primer and/or a polymerase.

Embodiment 88. The method of embodiment 87, wherein the PCR comprises about 4-8 cycles, about 10-40 cycles, or about 1-15 cycles.

Embodiment 89. The method of embodiment 86, wherein the PCR comprises about 30 cycles.

Embodiment 90. The method of embodiment 87, wherein the polymerase is a hot start polymerase.

Embodiment 91. The method of embodiment 86, further comprising detecting an amplicon generated by the amplification primers, wherein the presence of the amplicon determines whether the modified reverse transcriptase is present in the sample.

Embodiment 92. The method of any one of embodiments 1-20, further comprising a temperature of about 12° C. to about 42° C. for about 1 minute to about 5 hours.

Embodiment 93. The method of any one of embodiments 1-20, wherein the method is carried out as a one-pot (single vessel) reaction.

Embodiment 94. The method of any one of embodiments 1-12 and 15-20, wherein the template is between about 30 base pairs and about 15000 base pairs.

Embodiment 95. The method of embodiment 94, wherein the template is about 200 base pairs, or about 600 base pairs.

Embodiment 96. The method of any one of embodiments 1-12 and 15-20, wherein the template is between about 0.0001 micromolar and about 0.1 micromolar.

Embodiment 97. The method of embodiment 96, wherein the template is at least about 0.0001 micromolar.

Embodiment 98. The method of any one of embodiments 1-12 and 15-20, wherein the template or fragmented or degraded template is at least about 50 femtomolar.

Embodiment 99. The method of any one of embodiments 1-13, 15-16, and 18-20, wherein the acceptor nucleic acid molecule comprises at least one modified nucleotide.

Embodiment 100. The method of any one of embodiments 1-20, wherein the primer comprises one or more random primer(s).

Embodiment 101. The method of any one of embodiments 1-20, wherein the primer comprises an R2 RNA primer.

Embodiment 102. The method of any one of embodiments 1-20, wherein the primer further comprises an adapter sequence.

Embodiment 103. The method of any one of embodiments 1-20, wherein the modified reverse transcriptase, comprises a fusion with Fh8, MBP, NusA, Trx, SUMO, GST, SET, GB1, ZZ, HaloTag, SNUT, Skp, T7PK, EspA, Mocr, Ecotin, CaBP, ArsC, IF2-domain I, an expressivity tag, RpoA, SlyD, Tsf, RpoS, PotD, Crr, msyB, yjgD, rpoD, or any combination thereof.

Embodiment 104. A method for preparing a modified reverse transcriptase, which method comprises at least one of the following steps: (a) subjecting a DNA sequence encoding a reverse transcriptase enzyme to random or rational mutagenesis; (b) subjecting a DNA sequence encoding a reverse transcriptase enzyme to truncation of amino acids; (c) subjecting a DNA sequence encoding a reverse transcriptase enzyme to alteration comprising an insertion, a deletion or a substitution of an amino acid residue; (d) subjecting a DNA sequence encoding a reverse transcriptase enzyme to fusion with a protein or domain; and (e) subjecting a DNA sequence encoding a reverse transcriptase enzyme to homologous genes DNA shuffling; wherein the DNA sequence obtained in any one of steps (a) to (e) is expressed in a host cell, and wherein the modified reverse transcriptase comprises at least one improved enzyme property relative to a wild type or unmodified reverse transcriptase.

Embodiment 105. The method of embodiment 104, further comprising screening for host cells expressing the modified reverse transcriptase.

Embodiment 106. The method of embodiment 105, further comprising preparing the modified reverse transcriptase expressed by the host cells.

Embodiment 107. The method of embodiment 104, further comprising at least one of the following: determining the reverse transcriptase (RT) activity, estimating the reverse transcriptase active fraction(s), and testing the stability and robustness of the mutants.

Embodiment 108. The method of embodiment 107, wherein the RT activity, the RT active fraction(s), or the stability and robustness of the mutants are monitored via a reverse transcriptase activity assay.

Embodiment 109. A modified polypeptide having reverse transcriptase activity and at least one altered characteristic that improves enzyme property, wherein the modified polypeptide comprises an amino acid sequence having at least about 85% amino acid sequence identity to any one of the sequences corresponding to National Center for Biotechnology Information (NCBI) GenBank database Accession Numbers provided in TABLE 1.

Embodiment 110. A modified polypeptide having reverse transcriptase activity and at least one altered characteristic relative to a wild type or unmodified reverse transcriptase, which altered characteristic enables the reverse transcriptase to (i) generate a complementary deoxyribonucleic acid (cDNA) molecule from a template nucleic acid molecule without thermal cycling, and (ii) generate one or more copies of the cDNA molecule at an error rate of at most about 5%, wherein the modified polypeptide is a truncated variant of any one of the sequences corresponding to any one of the Accession Numbers provided in TABLE 1.

Embodiment 111. A modified polypeptide having reverse transcriptase activity and at least one altered characteristic that improves enzyme property, wherein the modified polypeptide comprises an amino acid sequence having at least about 85% amino acid sequence identity to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14. SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40. SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, or SEQ ID NO: 67.

Embodiment 112. The modified polypeptide of any one of embodiments 109-111, wherein the characteristic that improves enzyme property comprises at least one of the following: increased stability; increased specific activity; increased protein expression; improved purification; improved processivity; improved strand displacement; improved template jumping; increased DNA/RNA affinity; and increased fidelity.

Embodiment 113. The modified polypeptide of any one of embodiments 109-111, wherein the modified polypeptide comprises an N-terminal truncation, a C-terminal truncation, or N-terminal and C-terminal truncations.

Embodiment 114. The modified polypeptide of any one of embodiments 109-113, wherein the modified polypeptide comprises a truncation of less than about 100 amino acid residues.

Embodiment 115. The modified polypeptide of any one of embodiments 109-114, wherein the modified polypeptide comprises one or more of the following modifications: (a) an amino-terminal truncation of less than about 400 amino acid residues; and (b) a carboxyl-terminal truncation of less than about 400 amino acid residues.

Embodiment 116. The modified polypeptide of any one of embodiments 109-115, wherein the modified polypeptide comprises a fusion partner or a carrier protein.

Embodiment 117. The modified polypeptide of embodiment 116, wherein the modified polypeptide comprises a fusion with Fh8, MBP, NusA, Trx, SUMO, GST, SET, GB1, ZZ, HaloTag, SNUT, Skp, T7PK, EspA, Mocr, Ecotin, CaBP, ArsC, IF2-domain I, an expressivity tag, RpoA, SlyD, Tsf, RpoS, PotD, Crr, msyB, yjgD, rpoD, or any combination thereof.

Embodiment 118. The modified polypeptide of embodiment 116, wherein the fused variant comprises at least one of the following: increased shelf life, increased active fraction(s), and improved purification as compared to the non-fused polypeptide.

Embodiment 119. A non-naturally occurring enzyme that subjects a template nucleic acid molecule to reverse transcription to generate a complementary deoxyribonucleic acid (cDNA) product and amplification of the cDNA product at a processivity of at least about 80% per base as measured at 30° C.

Embodiment 120. A non-naturally occurring enzyme that subjects a template nucleic acid molecule to reverse transcription to generate a nucleic acid product and amplification of the nucleic acid product at a processivity of at least about 80% per base as measured at 30° C.

Embodiment 121. The non-naturally occurring enzyme of embodiment 119-120, wherein the non-naturally occurring enzyme has a performance index greater than 1.0 for at least one enzyme property.

Embodiment 122. The non-naturally occurring enzyme of embodiment 121, wherein the enzyme property is selected from the group consisting of improved stability, specific activity, protein expression, purification, processivity, strand displacement, template jumping, increased DNA/RNA affinity, and fidelity.

Embodiment 123. A non-naturally occurring enzyme that subjects a template nucleic acid molecule to reverse transcription to generate a complementary deoxyribonucleic acid (cDNA) product and amplification of the cDNA product in a time period of 3 hours or less at a performance index greater than 1.0 for at least one enzyme property selected from the group consisting of improved stability, specific activity, protein expression, purification, processivity, strand displacement, template jumping, increased DNA/RNA affinity, and fidelity, as measured at a temperature from about 12° C. to about 42° C.

Embodiment 124. A non-naturally occurring enzyme that subjects a template nucleic acid molecule to reverse transcription to generate a nucleic acid product and amplification of the nucleic acid product in a time period of 3 hours or less at a performance index greater than 1.0 for at least one enzyme property selected from the group consisting of improved stability, specific activity, protein expression, purification, processivity, strand displacement, template jumping, increased DNA/RNA affinity, and fidelity, as measured at a temperature from about 12° C. to about 42° C.

Embodiment 125. The non-naturally occurring enzyme of any one of embodiments 123-124, wherein the template nucleic acid molecule is a cell-free nucleic acid molecule.

Embodiment 126. A non-naturally occurring enzyme that subjects a template nucleic acid molecule to reverse transcription to generate a complementary deoxyribonucleic acid (cDNA) product and amplification of the cDNA product in a time period of about 3 hours or less at a processivity for a given nucleotide substrate that is at least about 5% higher than the processivity of a reference enzyme for the same nucleotide substrate.

Embodiment 127. A non-naturally occurring enzyme that subjects a template nucleic acid molecule to reverse transcription to generate a nucleic acid product and amplification of the nucleic acid product in a time period of about 3 hours or less at a processivity for a given nucleotide substrate that is at least about 5% higher than the processivity of a reference enzyme for the same nucleotide substrate.

Embodiment 128. A method of amplifying a nucleic acid molecule, comprising subjecting the nucleic acid molecule to nucleic acid amplification using a modified reverse transcriptase, wherein the reverse transcriptase is capable of amplifying the nucleic acid molecule at processivity of at least about 80% per base at about 30° C.

Embodiment 129. The method of embodiment 128, further comprising using the modified reverse transcriptase to subject a template nucleic acid molecule to reverse transcription to yield the nucleic acid molecule.

Embodiment 130. The method of embodiment 128, wherein the nucleic acid molecule is a cell-free nucleic acid molecule.

Embodiment 131. A kit comprising: a primer, one or more primer(s), or a random primer, nucleotides, at least one modified reverse transcriptase, a template, and instructions to perform the method of any one of embodiments 1-20.

Embodiment 132. The kit of embodiment 131, wherein the kit comprises a modified reverse transcriptase that has reverse transcription or nucleic acid amplification activity and is capable of template jumping at a temperature of about 30° C.

Embodiment 133. A kit for detecting nucleic acid comprising a template, at least one modified reverse transcriptase, nucleotides, and instructions to perform the method of any one of embodiments 34 and 13, wherein the nucleic acid is present at a concentration of at least about 50 femtomolar.

Embodiment 134. A method of detecting, diagnosing, or prognosing a cancer in a subject in need thereof, the method comprising: (a) obtaining sequence information of a cell-free nucleic acid sample derived from the subject of embodiment 10; and (b) using the sequence information derived from (a) to detect a tumor nucleic acid in the cell-free nucleic acid sample, wherein the tumor nucleic acid is detected at a concentration that is less than or equal to about 2% of total nucleic acid molecules in the cell-free nucleic acid sample.

Embodiment 135. The method of embodiment 134, wherein the tumor nucleic acid is detected at a concentration that is less than or equal to about 1.75% of total nucleic acid molecules in the cell-free nucleic acid sample.

Embodiment 136. The method of embodiment 134, wherein the sequence information comprises information related to at least 2 genomic regions.

Embodiment 137. The method of embodiment 134, wherein the obtaining sequence information of step (a) comprises using one or more adaptor(s).

Embodiment 138. The method of embodiment 137, wherein the one or more adaptor(s) comprise a molecular barcode comprising a randomer sequence.

Embodiment 139. The method of embodiment 134, wherein diagnosing or prognosing the cancer has a sensitivity of at least about 50%.

Embodiment 140. The method of embodiment 134, wherein diagnosing or prognosing the cancer has a specificity of at least about 50%.

Embodiment 141. The method of any one of embodiments 134, wherein the nucleic acid is RNA, DNA, or a combination of RNA and DNA.

Embodiment 142. A method for preparing a nucleic acid molecule for sequencing comprising: obtaining a sample with cell-free nucleic acid from a subject, wherein the cell-free nucleic acid comprises deoxyribonucleic acid (DNA) and ribonucleic acid (RNA) molecules; adding a poly tail to the nucleic acid comprising mixing the cell-free nucleic acid with at least one of a transferase or a polymerase, and at least one nucleotide substrate; mixing one or more primer(s) under conditions sufficient to permit the primer to anneal to the poly tail of the nucleic acid; and mixing a modified reverse transcriptase under conditions sufficient to amplify the nucleic acid, wherein the modified reverse transcriptase comprises at least one improved enzyme property relative to a wild type or unmodified reverse transcriptase.

Embodiment 143. The method of embodiment 142, wherein (b) comprises a transferase and a polymerase.

Embodiment 144. The method of embodiment 142, wherein the transferase comprises a terminal deoxynucleotidyl transferase (TdT).

Embodiment 145. The method of embodiment 142, wherein the polymerase comprises a poly A polymerase.

Embodiment 146. The method of embodiment 142, wherein the nucleotide substrate comprises at least one of dCTP, dGTP, dTFP, and ATP.

Embodiment 147. A method for preparing a nucleic acid molecule for sequencing comprising: mixing cell-free nucleic acid with an oligonucleotide-streptavidin conjugate, wherein the oligonucleotide-streptavidin conjugate is capable of annealing to the nucleic acid; and mixing the oligonucleotide-streptavidin conjugate annealed to the nucleic acid with a modified reverse transcriptase under conditions sufficient to permit transcription of the nucleic acid.

Embodiment 148. The method of embodiment 147, wherein the oligonucleotide-streptavidin conjugate comprises an oligonucleotide primer.

Embodiment 149. The method of embodiment 147, wherein the oligonucleotide-streptavidin conjugate comprises an oligonucleotide primer and an oligonucleotide acceptor.

Embodiment 150. The method of embodiment 149, wherein the oligonucleotide acceptor is in close proximity to the annealed nucleic acid so as to allow for template jumping.

Embodiment 151. The method of any one of embodiments 147-150, wherein the oligonucleotide-streptavidin conjugate comprises a magnetic bead.

Embodiment 152. The method of embodiment 151, further comprising enrichment of the annealed nucleic acid.

Embodiment 153. The method of any one of embodiments 142-152, wherein the cell-free nucleic acid comprises at least one of ssDNA, dsDNA, dsRNA, ssRNA, extracellular RNA, and RNA from an exosome.

Embodiment 154. A method for preparing a nucleic acid molecule using template jumping comprising: (a) annealing a primer to a nucleic acid template; and (b) mixing the template annealed to the primer with a modified reverse transcriptase, a polymerase with editing capabilities, and an acceptor nucleic acid molecule under conditions sufficient to generate a nucleic acid molecule.

Embodiment 155. The method of embodiment 154, wherein steps (a) and (b) are performed sequentially.

Embodiment 156. The method of embodiment 154, wherein steps (a) and (b) are performed simultaneously.

Embodiment 157. The method of any one of embodiments 142-156, wherein the reverse transcriptase is a DNA polymerase.

Embodiment 158. The method of any one of embodiments 142-156, wherein the reverse transcriptase is a non-long terminal repeat (LTR) retrotransposon.

Embodiment 159. The method of any one of embodiments 142-156, wherein the reverse transcriptase is an R2 reverse transcriptase.

Embodiment 160. The method of embodiment 158, wherein the non-LTR retrotransposon is an R2 non-LTR retrotransposon.

Embodiment 161. The method of any one of embodiments 154-160, wherein the acceptor nucleic acid molecule comprises a protected 3' end.

Embodiment 162. The method of embodiment 154, wherein the polymerase with editing capabilities comprises at least one of 3 to 5' exonuclease, T4 DNA polymerase, exonuclease I, Phi29, Pfu, Vent, KOD, exonuclease III, and exonuclease T.

Embodiment 163. A method for preparing a concatemer of nucleic acid molecules for sequencing comprising: ligating a nucleic acid molecule with a first adaptor; amplifying the ligated nucleic acid molecule by performing a nucleic acid amplification reaction in the absence of a primer to form a concatemer; and ligating the concatemer with a second adaptor.

Embodiment 164. The method of embodiment 163, wherein the nucleic acid amplification reaction is polymerase chain reaction (PCR) or isothermal amplification.

Embodiment 165. The method of any one of embodiments 163-164, wherein the first adaptor comprises a unique molecular identifier (UMI) sequence.

Embodiment 166. The method of any one of embodiments 163-164, wherein the first adaptor serves as a primer.

Embodiment 167. The method of any one of embodiments 163-164, wherein the first adaptor comprises single stranded nucleic acid.

Embodiment 168. The method of embodiment 167, wherein the single stranded nucleic acid comprises single stranded DNA (ssDNA).

Embodiment 169. The method of any one of embodiments 163-164, wherein the second adaptor comprises double stranded nucleic acid.

Embodiment 170. The method of embodiment 169, wherein the double stranded nucleic acid comprises double stranded DNA (dsDNA).

Embodiment 171. The method of any one of embodiments 163-164, wherein the first adaptor is different from the second adaptor.

Embodiment 172. The method of any one of embodiments 163-164, wherein the first adaptor comprises two or more adaptors.

Embodiment 173. The method of any one of embodiments 163-164, wherein the second adaptor comprises two or more adaptors.

Embodiment 174. The method of any one of embodiments 163, wherein both ends of the nucleic acid molecule comprise an adaptor.

Embodiment 175. The method of any one of embodiments 142-174, wherein the nucleic acid molecule comprises at least one of ssDNA, dsDNA, dsRNA, ssRNA, extracellular RNA, and RNA from exosome.

Embodiment 176. The method of embodiment 163, wherein the adaptor comprises a nucleotide modification.

Embodiment 177. The method of embodiment 176, wherein the nucleotide modification comprises a methylated nucleotide.

Embodiment 178. The method of embodiment 176, wherein the nucleotide modification comprises dUTP.

Embodiment 179. A method of depleting ribosomal and/or transfer RNA from a sample for library sequencing comprising: providing a sample comprising RNA, wherein the RNA comprises ribosomal RNA (rRNA) and/or transfer RNA (tRNA); performing an amplification reaction (e.g., a polymerase chain reaction (PCR) or an isothermal amplification) to convert the rRNA and/or tRNA to double stranded DNA (dsDNA), wherein the amplification reaction is a partial amplification reaction or a full/complete amplification reaction; introducing a complex comprising a nuclease or a polynucleotide encoding the nuclease and at least one specifically designed guide oligonucleotide, wherein the at least one guide oligonucleotide comprises at least one sequence complementary to at least one dsDNA and the nuclease or polynucleotide encoding the nuclease cleaves at least one strand of the dsDNA.

Embodiment 180. A method of depleting ribosomal and/or transfer RNA from a sample for library sequencing comprising: providing a sample comprising RNA, wherein the RNA comprises ribosomal RNA (rRNA) and/or transfer RNA (tRNA); performing an amplification reaction (e.g., a polymerase chain reaction (PCR) or an isothermal amplification), wherein the amplification reaction is a partial amplification reaction or a full/complete amplification reaction to convert the rRNA and/or tRNA to double stranded DNA (dsDNA); denaturing the dsDNA into single-stranded DNA (ssDNA) strands; introducing at least one specifically designed oligonucleotide comprising a binding molecule and at least one sequence complementary to at least one ssDNA strand to form a hybridized complex of the oligonucleotide and the at least one ssDNA strand; immobilizing the hybridized complex to at least one solid support, thereby removing the hybridized complex from the sample.

Embodiment 181. A method of depleting ribosomal and/or transfer RNA from a sample for library sequencing comprising: providing a sample comprising RNA, wherein the RNA comprises ribosomal RNA (rRNA) and/or transfer RNA (tRNA); introducing at least one specifically designed oligonucleotide comprising a binding molecule and at least one sequence complementary to at least one rRNA and/or tRNA to form a complex comprising the oligonucleotide and the at least one rRNA and/or tRNA; immobilizing the complex to at least one solid support, thereby removing the complex from the sample.

Embodiment 182. The method of any one of embodiments 181-182, wherein the binding molecule is biotin.

Embodiment 183. The method of any one of embodiments 181-182, wherein the at least one solid support is streptavidin.

Embodiment 184. A method of producing a cell free deoxyribonucleic acid (cfDNA) library comprising: providing a sample comprising cfDNA; denaturing the cfDNA to produce a single stranded DNA (ssDNA) sample; introducing, in the presence of nucleotides and/or a catalytic metal, a complex comprising a template, a primer, and a reverse transcriptase to the ssDNA sample, wherein the reverse transcriptase extends the primer on the template and subsequently template jumps to the ssDNA sample to produce a double stranded DNA (dsDNA) sample (e.g., wherein the double stranded DNA comprises a copy strand and an original strand (copy strand is the strand that resulted from the extension by the reverse transcriptase, and the original strand is from the sample)), and wherein the dsDNA comprises at least one nick between the template and the ssDNA; introducing a polymerase comprising a 3'-to-5' exonuclease activity to generate a dsDNA with blunt ends and/or a 3'-overhang; introducing an (asymmetric) adapter comprising a nucleic acid duplex with a single-stranded overhang at the 5' end, wherein the (asymmetric) adapter is ligated to the 5' end of the dsDNA, and wherein the single-stranded overhang comprises a sequence complementary to at least one polymerase chain reaction (PCR) amplification primer; and performing a PCR reaction to amplify only one strand of the dsDNA (further wherein the one strand of the dsDNA is the original DNA strand).

Embodiment 185. The method of embodiment 184, wherein the one strand of the dsDNA (original strand) improves fidelity of PCR amplification.

Embodiment 186. A method of producing a cell free deoxyribonucleic acid (cfDNA) library comprising: providing a sample comprising cfDNA; denaturing the cfDNA to produce a single stranded DNA (ssDNA) sample; introducing a terminal deoxynucleotidyl transferase (TdT) and a deoxyadenosine triphosphate (dATP) (and optionally a non-extendable nucleotide) to the ssDNA sample to generate a poly(A) and/or a poly(C) tail, annealing a complex comprising a primer and a first adapter to the tail of the ssDNA sample, wherein the complex comprises a sequence complementary to the tail; introducing, in the presence of nucleotides and/or a catalytic metal, a reverse transcriptase and a complex comprising an acceptor and a second adapter to produce a double stranded DNA (dsDNA) sample, wherein the nucleotides comprise degradable nucleotides, wherein the reverse transcriptase extends the primer and subsequently template jumps to the complex to continue extension; and wherein the complex comprises a nucleotide block to prevent the reverse transcriptase from reaching the end of the complex and jumping to another complex, wherein the dsDNA comprises an original strand and a copy strand, wherein the original strand comprises at least one nick between the complex and the ssDNA and the copy strand comprises at least one degradable nucleotide; introducing a polymerase comprising a 3'-to-5' exonuclease activity to generate a dsDNA with blunt ends or a 3'-overhang, and a DNA ligase to ligate the at least one nick; introducing at least one uracil-DNA glycosylase to degrade the at least one degradable nucleotide to deplete/remove/degrade the copy strand (thereby resulting in only the original strand being present); and, performing a polymerase chain reaction (PCR) comprising at least a first primer and/or at least a second primer to amplify the original strand, wherein the first primer comprises a sequence complementary to the first adapter and the second primer comprises a sequence complementary to the second adapter.

Embodiment 187. The method of embodiment 186, wherein the original strand improves fidelity of PCR amplification (i.e., removing the copy strand and leaving only or mostly the original strand improves fidelity during PCR amplification).

Embodiment 188. A method for preparing a nucleic acid library for sequencing comprising: (a) obtaining a plurality of nucleic acid molecules; (b) inducing a non-enzymatic intramolecular transphosphorylation of at least one molecule in said plurality of nucleic acid molecules by increasing a temperature of said plurality of nucleic acid molecules, thereby providing a plurality of nucleic acid molecules with a free 5'-phosphate moiety; (c) adding a phosphatase to said plurality of nucleic acid molecules with said free 5'-phosphate moiety whereby the phosphatase converts one or more of said free 5'-phosphate moieties to a hydroxyl group, thereby providing a plurality of nucleic acid molecules with a free hydroxyl group; (d) mixing, in the presence of an amount of adenosine triphosphates a product of step c) and a polymerase, whereby said polymerase generates a poly(A) tail from at least one molecule of said plurality of nucleic acid molecules with a free hydroxyl group; (e) mixing, in the presence of nucleotides, (i) one or more primers comprising a sequence complementary to said poly(A) tail; (ii) one or more acceptor nucleic acid molecules; and (iii) a modified reverse transcriptase, whereby said modified reverse transcriptase generates a plurality of continuous complementary deoxyribonucleic acid molecule by reverse transcribing a sequence of an annealed template nucleic acid molecule, migrating to an acceptor nucleic acid molecule, and reverse transcribing a sequence of said acceptor nucleic acid molecule; (f) adding at least one solid support to a product of (e), whereby said solid support immobilizes an excess of said one or more primers comprising a sequence complementary to said poly(A) tail; and (g) performing a polymerase chain reaction (PCR) reaction.

Embodiment 189. A method of producing a library for sequencing comprising: providing a sample comprising ribonucleic acid (e.g., cfRNA); subjecting the sample to high temperature sufficient to allow for transphosphorylation of the RNA (optionally, further wherein a catalytic metal (magnesium) and/or a polyamine is introduced to the sample); introducing a phosphatase to convert a phosphate moiety of the RNA to a 3'-hydroxyl group; introducing an adenosine triphosphate and a polymerase to generate a poly(A) tail on the 3'-hydroxyl group of the RNA; introducing, in the presence of nucleotides, a primer, an acceptor, and a reverse transcriptase, wherein the primer comprises a sequence complementary to the poly(A) tail thereby annealing to the poly(A) tail, and wherein the reverse transcriptase extends the primer and subsequently template jumps to the acceptor to continue extension; introducing at least one solid support to immobilize excess primer and non-specific primer products to the at least one solid support, thereby removing the excess primer and the non-specific primer products from the sample; and performing a polymerase chain reaction (PCR) reaction to amplify the RNA.

```
AAB59214.1 reverse transcriptase-like protein [Bombyx mori];
                                                                    SEQ ID NO: 1
MMASTALSLMGRCNPDGCTRGKHVTAAPMDGPRGPSSLAGTFGWGLAIPAGEPCGRVCSPATVGF

FPVAKKSNKENRPEASGLPLESERTGDNPTVRGSAGADPVGQDAPGWTCQFCERTFSTNRGLGVHK
```

```
RRAHPVETNTDAAPMMVKRRWHGEEIDLLARTEARLLAERGQCSGGDLFGALPGFGRTLEAIKGQ

RRREPYRALVQAHLARFGSQPGPSSGGCSAEPDFRRASGAEEEAGEERCAEDAAAYDPSAVGQMSPD

AARVLSELLEGAGRRRACRAMRPKTAGRRNDLHDDRTASAHKTSRQKRRAEYARVQELYKKCRS

RAAAEVIDGACGGVGHSLEEMETYWRPILERVSDAPGPTPEALHALGRAEWHGGNRDYTQLWKPI

SVEEIKASRFDWRTSPGPDGIRSGQWRAVPVHLKAEMFNAWMARGEIPEILRQCRTVFVPKVERPG

GPGEYRPISIASIPLRHFHSILARRLLACCPPDARQRGFICADGTLENSAVLDAVLGDSRKKLRECHV

AVLDFAKAFDTVSHEALVELLRLRGMPEQFCGYIAHLYDTASTTLAVNNEMSSPVKVGRGVRQGD

PLSPILFNVVMDLILASLPERVGYRLEMELVSALAYADDLVLLAGSKVGMQESISAVDCVGRQMGL

RLNCRKSAVLSMIPDGHRKKHHYLTERTFNIGGKPLRQVSCVERWRYLGVDFEASGCVTLEHSISSA

LNNISRAPLKPQQRLEILRAHLIPRFQHGFVLGNISDDRLRMLDVQIRKAVGQWLRLPADVPKAYYH

AAVQDGGLAIPSVRATIPDLIVRRFGGLDSSPWSVARAAAKSDKIRKKLRWAWKQLRRFSRVDSTT

QRPSVRLFWREHLHASVDGRELRESTRTPTSTKWIRERCAQITGRDFVQFVHTHINALPSRIRGSRGR

RGGGESSLTCRAGCKVRETTAHILQQCHRTHGGRILRHNKIVSFVAKAMEENKWTVELEPRLRTSV

GLRKPDIIASRDGVGVIVDVQVVSGQRSLDELHREKRNKYGNHGELVELVAGRLGLPKAECVRATS

CTISWRGVWSLTSYKELRSIIGLREPTLQIVPILALRGSHMNWTRFNQMTSVMGGGVG

T18197 reverse transcriptase-like protein - silkworm;                    SEQ ID NO: 2

MMASTALSLMGRCNPDGCTRGKHVTAAPMDGPRGPSSLAGTFGWGLAIPAGEPCGRVCSPATVGF

FPVAKKSNKENRPEASGLPLESERTGDNPTVRGSAGADPVGQDAPGWTCQFCERTFSTNRGLGVHK

RRAHPVETNTDAAPMMVKRRWHGEEIDLLARTEARLLAERGQCSGGDLFGALPGFGRTLEAIKGQ

RRREPYRALVQAHLARFGSQPGPSSGGCSAEPDFRRASGAEEEAGEERCAEDAAAYDPSAVGQMSPD

AARVLSELLEGAGRRRACRAMRPKTAGRRNDLHDDRTASAHKTSRQKRRAEYARVQELYKKCRS

RAAAEVIDGACGGVGHSLEEMETYWRPILERVSDAPGPTPEALHALGRAEWHGGNRDYTQLWKPI

SVEEIKASRFDWRTSPGPDGIRSGQWRAVPVHLKAEMFNAWMARGEIPEILRQCRTVFVPKVERPG

GPGEYRPISIASIPLRHFHSILARRLLACCPPDARQRGFICADGTLENSAVLDAVLGDSRKKLRECHV

AVLDFAKAFDTVSHEALVELLRLRGMPEQFCGYIAHLYDTASTTLAVNNEMSSPVKVGRGVRQGD

PLSPILFNVVMDLILASLPERVGYRLEMELVSALAYADDLVLLAGSKVGMQESISAVDCVGRQMGL

RLNCRKSAVLSMIPDGHRKKHHYLTERTFNIGGKPLRQVSCVERWRYLGVDFEASGCVTLEHSISSA

LNNISRAPLKPQQRLEILRAHLIPRFQHGFVLGNISDDRLRMLDVQIRKAVGQWLRLPADVPKAYYH

AAVQDGGLAIPSVRATIPDLIVRRFGGLDSSPWSVARAAAKSDKIRKKLRWAWKQLRRFSRVDSTT

QRPSVRLFWREHLHASVDGRELRESTRTPTSTKWIRERCAQITGRDFVQFVHTHINALPSRIRGSRGR

RGGGESSLTCRAGCKVRETTAHILQQCHRTHGGRILRHNKIVSFVAKAMEENKWTVELEPRLRTSV

GLRKPDIIASRDGVGVIVDVQVVSGQRSLDELHREKRNKYGNHGELVELVAGRLGLPKAECVRATS

CTISWRGVWSLTSYKELRSIIGLREPTLQIVPILALRGSHMNWTRFNQMTSVMGGGVG

KMQ90176.1 reverse transcriptase [Lasius niger];                         SEQ ID NO: 3

MSGPGGGTPQHAGPSALSSKLDEFRLRVCSEGSALHGQDAAQRRAKRLATSPPHDPIDLELDPPPLS

DAGLRGIKDELSAHDITFASINATSKESVNRKKELEEVIAAYRRAVDDLMMAYIKIKTERDTTAKIW

KMMRSTSRGDSGSDLGIEIAGAVQESTGAAIRGMLGEWHARESERTKALVTEMTASMSGQFEGCV

RRAVETLASFREAPSVPQIAGRSYAGAVRASGAVAGPQLPSGRRELRDQSRLETIEVVPGENMSKNL

PDSEATCRAVLTSIKPSEAGIKVDRVIKGRNKTVRIVADQDEISRLRPMLDNLGMEVKRVDKLNPRL

RIRDIPVGTDKSLFVKDLIKQNLDGASEEDIRLVYWSPAKGRMGPAAVIEVSPDIRIRLLNQGRVYLG

WSSCRVADHLRVLQCFKCLGFGHTANNCQAGSDTCGHCDNVHNSVDNLNVGRLDGFVCPICLRSF
```

-continued

SSKIGLGLHKKKKHPVEYNEEIVVARVRPRWTDEEIRLLAIDEAGAPPQTRSMNSYLLERRGDDRSL

ESIKGVRRKQAYKDLVAEYRGQLLDQRIDESLSQPDARPIAAMVDGVPLSGSVAAKDWLLAKCDSI

IPEMNGGIWIRTAIRRLEEGQSPEGALDDWWNNVFSDLEVTGRKRVARGPRAIPVLSKRKARRIEYR

RMQQLWRTNMTKAAHKVLDGDAGSLPHPTLAAQLGFWKPVLEAESVDLAWPFAVGHPGVAVGD

LWSPITEGEVINIRLPRTSSPGLDGLTVHRWFTEVPAILRATILNIFMATGWVPPRFRHSRTVLIPKSSD

LMDPAYYRPISVSSVILRHFHKILARRVAACELLDVRQRAFIAADGCAENVAVLSAILFDARTNRRQ

LHVITLDVRKAFDTVSHNAIRYVLSKHGMPQIMVEYLSTLYRTAAVRLEVDGEFSDEILPGRGVRQG

DPLSPLLFNLIMNEILAEVPDQVGYCMMDRNVNALAFADDLVLIGATRDGAQRSLERVMAALYRF

GLELAPAKCAAFSLVPCGKTKRIKILTDPQFVAGDRPIPQLGVLHTVRYLGVRFGETGPVIQGVELLP

LLERITRAPLKPQQRLKILRTYLIPRYTHNLVLGRVSYSMLRKLDKQTRAAVRRWLVLPDDVPVAFF

HCPIKQGGLGIQSFETAIPRLTLLRLNRLKDSQYEMARVVGSSAWADRRMRWCRFARRRDEDWPSE

LHAKVDGFELREAGNVSVSTRWLDDAMVHIPSSDWLQYVKVWINALPTRIRTTRGSRRLREDVNC

RGGCGVQETAAHVVQQCFRTHGGRIMRHDAVASALAGELQRGGYNVHRERVFRTREGVRKPDIL

AAKGTHGHVLDVQIISGARPLSDGHDRKRSYYANNADLLARISALLQVPVRNLDVSTVTLSWRGV

WARESAAVLTSLGVSKAVLRGITTRVLKGSYMNFSRFNQTTATCRGRANLRMSGWGPP

KYB24671.1 Retrovirus-related Pol polyprotein from type-2 retrotransposable element
R2DM-like Protein [Tribolium castaneum];
SEQ ID NO: 4

MSNPSSVPCLLASRGTVLLRGSGCARQGVRKSSSAAIQRALNVNVKKFKQARVNGGSNYDSLILLC

YDFAAGRNADGEPAQNPCPYCARSFTTANGRGLHIRRAHPDEANNAIDIERIHARWSDEETAMMAR

LEAGAIQQGGVRFMNQFLVPRMPGRTLEAVKGKRRDATYKALVQRFLQAPQINLPELRDGDAPRQ

PDPQRENPPEPPAFDGAIRGAVADLVGGVDWQRLGFQGDRLCDIARRACDGEDVSGQLLGWLRDV

FPVKRVSTRGDQSDLDVDGASVSRRTARRREYARVQELYRKDPKACLARILGDRREGANRAPNRD

PAFIDFWRGVFSEASAEVEGWAEEVSDHGELARRVWDPISVEEVGRSRVRNGAAPGPDGIAVSVW

NKLPPEAAALLFNVLLLGRCLPAELTRTRTVFIPKTDAPRTPADYRPISIASVVARHFHRVLSARVQRI

PDLFTKYQRGFLSGVDGIADNLSVLDTMLTMSRRCCKHLHLAALDVSKAFDTVSHFAIVRACEQAG

LPQPFVEYVRSIYGSAETVLEEGGRRHFVQVRRGVRQGDPLSPLLFNVLDRALKRLSTDVGFRLTD

ATKVTALAFADDVVLCATTAKGLQTNLDVLEAELRLAGLLLNPNKCQALSLVASGRDHKVKLVTK

PTFRVGQNTIHQVDASSIWKYLGIQFRGSGMCGCGSEGVAAGLKRITCAPLKPQQRMHLLRVFFLPK

FYHAWTFGRLNAGVLRRLDVVVRTYVRTWLRFPHDIPVGYFHAPTKSGGLGIPQLSRFIPFLRLKRF

DRLGRSAVDYVRECAFTDIADRKIRWCRERLSGIVDQVAGGRDALDAYWTAQLHQSVDGRALRES

ASVASSTQWLRCSTRAIPASDWLHYTAVHIGALPSRVRTSRGRRGGQDVSCRGGCLLDETPAHCIQ

VCHRTHGGRVLRHDAIAKRISVDLMELGWIVTREVSFRTTAGVFRPDMVAVKEGVTVILDVQIVSP

APTLDEAHRRKVAKYRDRADLARYLVEAAVARGRAPPANIRFASATISWRGVWSAESVGSLRELG

LSARHFNRYTTMALCGSWRNWVRFNASTASRMGRGRGDASPRRHENQHDNDSLADLVRVALTKS

DRGVLNDAVNRNLAQRAESLRIRKRGSKGKRKSKTGRHYGQTTSGSGQRAALFKKHQDLFLKNRR

GLAETILSGKEDFGPRPEPPVTSVEEFYGGIFESPSSPDNKPFERQIPVAAVKTMSELELAILFNIILFRN

VQPSAWGVLRTTLVPITISSALQRLLHRVLAARLSKLISLSSSQRGFTEIDGTLANALILHEYLQYRRQ

TGRTYHVVSLDVRKAFDTVSHCSVSRALGCFGIPSVIREYILATFGAQTTIKCGSVTTRPIRMLRGVR

QGDPLSLVLFNFVMDELLEKVNEKYEGGSLQSGERCAIMAFADDLILIADRDQDVPAMFDDVSTFL

ERRGMSVNPAKCRALIAGAMHLSIWG

KMQ90064.1 reverse transcriptase [*Lasius niger*]; SEQ ID NO: 5

MNVGEDVAVLDVGRPNSHVCPICLRSFTSRIGLGLHKKKRHPVEYNEEICIARVKPRWSEEEIRILAM

EEARAPPRTKSMNVYLWERGDESRSLESIKGVRRKQSYKDLVISYKDQLLAEKVDESLERQCSVPV

VPAETPLPGSEAAMKWLVARVDDIIPEMNGGIWVRAAVCRLREGCLPDAALDDWWRNVFSDLETA

RSGRISRGPRVAPVLSKRRARRVEYRRMQQLWKVNMTKAAHKVLDGDTDSLPHPTLAEQLDFWRP

VLEASSASFVRPVGAGKVVDGLESVWSPITEGEVINIRLPPSSAPGLDGLTVNRWFAEVPAILRATIL

NIFMATGRVPPRFSGSRTVLIPKSLDLMDPSCYRPISVSSVVLRHFHKILARRLAAFNLLDTRQRAFIA

ADGCAENIAMLSALLFDARANLRQLHVLTLDVRKAFDTVSHDAIRYVLRRNGIPAGMVEYLSTLCR

TSTIRLEVGGAFSDELFPGRGVRQGDPLSPLIFNLVMNEILAVVPEQVGYNMLGHNINALAFADDLV

LVAATREGAQRSLDRVVAALSDFGLELAPAKCAAFSLVPSGKLKKMKVLSDPQFAAGGCAVPQLG

VLQTMRYLGVWFADAGPVDREVELLPLLDRITRAPLKPQQRLKILKTFLIPRFIHILVLGRTSYGLLR

KLDRQIRAAVRRWLRLPEDIPKAFFHSPIASGGLGILSYETAIPRLVLARLDRLDKSQYDAARMVGSS

AWAVRKRRWCGLAKRVEENWPAEFYGMVDGFELREAGNVTASTNWLDDPMIRVPSSEWLEYVK

VWINALPTRIRTTRGSRRLREDVACRGGCGVQETAAHVIQQCFRTHGGRIMRHDAVASTLAGELQR

GGYKVRREHVFRTPVGVRKPDILASKGERGYVLDVQIISGARPLTEGHKRKRNYYAGNAELLAKAR

ESATTLTSLGVSKAVLRGITTRVLKGSFMNFARGPALTRQASVTSAEASSAHICDFPGCGRTFSTKTG

RGVHQRRAHPDWFDGQQTTAMVKARWSEEETLLLARKEVELVRQGERFINQALFEVFPERSLESIK

SKRKQPAYRDAVGTIMDSIAREDNAGVPLNVPVPDSANLKRNIEEHLSALPAPSSSAFMSARLAGIC

DSLTRKSQVAVVEELSLYLRSVFPIKPRGARPSGNVVTDAPSKRQERRAEYARAQDLWRKNRCKCL

RMLLDDITGVNVPPKETMVPFWETIMTGNFPTSPGCDVLAPATNDLWLPITALEIRRALPAGTTSAG

PDGLTARFLRRVPMEILERILNVILWCEKAPTHLMESATTLIPKKSNAHTPSDFRPITVSSVLLRTLHK

VLATRMARLVQIDQRQRAFRPTDGCSENVFLLDLILRYHHRHHKPLFMASLDIAKAFDSVSHKTIEE

TLAIMGIPSPMRAYIMDVYQRSSTVLCCGSWTSRKIQPTCGVKQGDPMSPIIFNMIMDRMLKQLPGD

IGTRIGGSTINAAAFADDMLLFASTPLGLQKLLDKSTDFLRKCGLQVNTSKYMTISLRNVPREKKTV

VDRETVFLCQDKVLPALKRTDEWNYLGIPFTPKGRMKLNIAQKLQSSLDKLTKTPLKPQQRLFGLR

VMVIPGLFHQAELGNINISVLRKCDRLVRCRVRQWLSLPSDVPNAYIHANVKDGGLGITALRWTHT

GRIKRHDAIVSFVSRLLEVQGYDVSVEPRIKSDHGLKKPDIVAKLGVTAIVLDAQVVNDQISLDEAH

QRKIDYYQDIEGNVKETFRVQNVIYSSITLSWRGLWSQKSVNSLTDLGIIKKKHIKIISTRAIIGGLTSF

HIFNKATYVQGRAG

ACJ71597.1 reverse transcriptase [*Rhynchosciara americana*]; SEQ ID NO: 6

MSNYNETNTSGGDNPRMATQTTGSLSSGPINQHTCELCCRTFGTRAGLGQHVRKTHPIESNQSINVE

RKKRRWSPEEIRRMANMEAQATINNIKHLTQYLATYLPQRTLNAIKGRRRDAEYKELVTGIIANLRS

NSSTQQTNQVCNESEMSQRSKILQSIRESVRDLRSRRNKYAKALQELGEAALCGKMLNEEQLIHCIK

SMFNTAKCPKGPRFRKTATHSGTNKQQRQQRYARVQKLYKMNRKVAAKMVLEETDKIQIKLPDH

DPMFKFWESEFKEGEGMPERMPKDLKESPDLKAIWDPVTEEEVRKAKVANNTAAGPDGIQPKSWN

RISLKYKTLIYNLLLYYEKVPHKLKVSRTVFIPKKKDGSSDPGEFRPLTICSVVLRGFNKILVQRLVSL

YKYDERQTAYLPIDGVGTNIHVLAAILNDSNTKLSELHVALLDITKAFNRLHHTSIIKSLVGKGFPYG

FITFIRRMYTGLQTMMQFEGHCKMTQVNRGVYQGDPLSGPIFLLAIEKGLQALDKEVGYDIGDVRV

NAGAYADDTDLVAGTRLGLQDNINRFSSTIKQVGLEVNPRKSMTLSLVPSGKEKKMKVETGKPFRA

NDVPLKELSINDFWRYLGISYTNEGPERLSLTIEQDLERLTKAPLKPQQRIHMLNAYVIPKYQDKLVL

```
SKTTAKGLKRTDRQIRQYVRRWLKLPHDVPIAYLHAPVKSGGLNIPCLQYWIPLLRVNRVNKITESQ

RSVLAAVGKTALLTSTVYKCNQSLATLGGNPTMLAYRTYWEKELYAKVDGKDLQNARDDKASTR

WNGMLHSDISGEDYLNYHKLRTNSVPTKVRTARGRPQKETSCRGGCKSTETLQHVVQQCHRTHGG

RTLRHDRIVGLLQHELRRDYNVLAKQELKTGIGLRKPDLVLIKDDTAHIVDVQVARCSKLNESHVR

KRSKYDKKEIEVEVKSRYRVSKVMYEACTISYKGIWDKQSVMSMRRLGVSEYCLFKIVTSTLRGTW

LCWKRFNMITSVRS
```

AFM44926.1 R2 protein [*Eyprepocnemis plorans*];  SEQ ID NO: 7

```
MVGPTTRSKKGTGPPTGASVPTTESASQSSGAGRALLPASCPLCQRSFTTVNGLGQHRRRAHPEVV

NAEIQTDRKKARWSKEELMRLAHAEARLVIEGCRFLNQELLKSFPDRTLDSIKGQRKGKAYRESVA

SFVSQLRSSVASAGPSGASPVAEEPLPGSPSVSQDDEVDAAIWSALADLPSSGSRFKLVDDIVALGPN

TSRDIVRSMLPSALDAVGSKEPAAHPPLPFGARRPPDKKRARRRWEYAAVQRAFRKNAARCVNGL

LDGTLLHQPPSIPGLVEFWKDLFTAPCASSRPRSKEGLSPMLLASSQPVSFRDLWAPITSEEAAAALP

PRNSAAGPDALTPAQLRRLPHPVFLKILNLFLLARSLPSRLLRARTTLLPKKTSPASPADFRPITVCSV

LARAFHKVLAGRLMRYCVLDGRQRAFIPQDGMLHNSFLLDLAMAHSRRTACSLYVASLDVSKAFD

SLDHGALSPVLRAHGLPVEFVEYVRGCYQASTTVICGGGSSSDLVRPSKGVRQGDPLSPILFNLSIDL

LLSRLPGYIGARIFSRRVNAAAFADDILLFAETKGGLQELLSTATSALGDLGLEVNPFKCFSLALVAS

GREKKVKVDNSVIFRAGNKNIPALAMGDTFRYLGLQFSTSGLSQFHPRQEVQEQLDIIKRAPLKPQQ

RLFALRSVILPGTYHGLALGRTRLGALKSLDVCVRAAVRAWLRLPDDTPIGYFHAPVIYGGLGIPAT

RWLGPLLRRRRLASMEGLGVIVDEPSQDILKREICRLDNYLKWDGDVIKTSYQLGRFWALRLHSSV

DGAALRRSAQTPGQHSWVSNTRLMLSGRDFLACVRARISALPSRARLLRGREGDTRCRAGCNASET

NNHVIQHCWRSHEARVERHDAVALYMVRGLRRRGYDVHRELHLRTSQGLKKPDIVAVSGTTAFVI

DAQVIGDHLDADRCHREKVEVYDQQPVHTEIKRMFPEVQMITTTSATLNWRGVWSPASAKALIGIG

FNSNHLSTMATRALLGSIMAARRFDSMTAPRRRMMPRTGVG
```

AHN53448.1 reverse transcriptase, partial [*Nuttalliella namaqua*];  SEQ ID NO: 8

```
QTIRGLGQHIRIKHPTVSNAKISVATSKVRWTDEEIHLLAKEEARLIKLGKKYLNQELQSYMPHRSLE

AIKGQRKSEIYKERVKHLVETKLLEVEPTMSEVLEPTESQKKDSFQKEIEKIITNTPPRKFQGERLWEI

ARKAIRGEDIYRDLNDYVVDTFVVATKPHPQAKGKSYTTAPPSSRRKRRRRLYGRMQEMMRRKPA

DCAKIVLDGERVASKINSEEFFDYWEKLTTKEPSNWPLSSDTAQRENLKDPMFPVTLREIKENLPSPH

SAPGPDGCSARLLRAVPPLTLQLVLDLLLFVRRPLASLKGARTIFIAKKDAASHPKDFRPISISPILLRF

LHRILARRLNRMVPIDKVQRGFQPRDGCAECAILLTMAIKESRSKLKSLYLASVDISKAFDSVTFEAL

DSALKRVGLSEGFIGYIRDLYTSGNTLFQFDNQCRTVVPTNGVRQGDPLSPFLFNIVLDEFFSTMEQE

IVFDKNGLNLSALAYADDLVVFASSQRGLQHRLEEAYSFFKKKGLEINVEKSFTLSLQAAGKEKKIK

VREDMRFNVAGMVLPALDINSVFGYLGVSFSPLGRPSETWEELKDYLDRISSAPLKPQQRLYILRGF

LVPRLIYRLVLGRWTAGTLLKLDRQIRAAIRRWIGLPHDCPLGYFHAKIGSGGLGIPSMRTMIPELLL

RRLTKLEMNETMGTKEIPKCESYWYYVKKMEDLTKYDGHKLDTKYACQRYWAQKLYKSVDGRD

LEASSKVPFANHWILDHTRWLPGYEYCKMVKFKVNAMPVLTRTSRGLDRPRNCRGGCDQQESLKH

VVQHCHRTHGARIKRHDNIVDFIGKRLAAKGYGVLKEPRVKTSTGILKPDLVVTGDDRVLIIDAQV

VGSGQYLTEDHLRKVKKYNIDEVKDYFKEPRKCVAVTSVTVSFRGVWCANSAKELIELGLTKNDIK

VVSAICLQGGVRAHSLFSNVTSVLKHR
```

ACJ46647.1 reverse transcriptase [*Triops cancriformis*];
SEQ ID NO: 9

MSQKRRPEKAVPDEGATAHDVAQPDKSKCSVCGETFKGPASVTMHMVKKHPVEFNELKMAKKPV

PKKVRWSEEEIFQLARTEAELTLQGVRFINVELQKIFPAREIEGIKGQRKLAKYKELVKDQLDEIGRA

PNPPEQEIGEDVPSPFKAWLELLLALPKTPNDFLEHKLDNIIVQALKEDVNSDQVFNDLNSYLKLILE

PSGRAKSVPGEIIHGDPSGSAKTSVTKAPKPATVSSSRKKRRDAEFARIQRLYRKNRTSCINTILDGNT

REHEAPKNMEGFWREIFERESPDDPDDPDIFLEEEASDIWKYISFYEMCNLYPPPSTAPGPDGFSSKD

LRRMTPRVLNKILNLLLHLRDLPQILKSHRTVLIPKTDLPTKPGDFRPITISNILVRHLNKILANRVSHL

IPINERQKAFLPIDGCAENIFTLDFILHHARTKIKSLSMAILDISKAFDSVSHHSIFRALREARCPIGFIKF

IENCYGGCFTKLFCGGVKYPSEVSMNRGVKQGDPLSPVLFNLVIDGLIRQIPSALGFNVSDQVKVSCI

AYADDLILIATTRAGLKTLLDLTNSYLAKRGLSLNPDKCSALSIVASGKQKLVYIASSEHFDLAGQK

MRNLNVGDSWRYLGIQFSHLGRAEKVTPDLTCLINRLQKAPLKLQQKLYALRIYLIPRLIHGLTLSK

TNLGELKTLDKLIRKYIRAWLHLPDDTPMGYFYTPLKAGGLGLPSLRLVILNNRLERILRMKASQDII

VRTIAESETLGVEIRKLHDLLSIDGTILDTSVKIHSFWAERLYSSYDGKCLCNSANFPPGNKWIGEDSL

NQRSHIFADCLKLRINALPTRSRTARGRPLKDKPCRAGCRNSDGVKVIETLNHITQVCERTHGARVK

RHDRLVDFAVKGLQRPHRVVLKEPHYKTVNGVRKPDIVIKIPDHTYICDFQVVSDTSCLELEFRKKA

LKYAEDKGLCDQLTRDHPGELSFTAITFNTRGLIAKSSVTALRKLGMPPRSIMTLQKICMEGSLEIWR

IFNQTTAMARN

BAC82590.1 reverse transcriptase [*Ciona intestinalis*];
SEQ ID NO: 10

MGEWPWVSWSLTVLVEKWRPFTILQPYPMPGQLRVDVYLPRKTSYLMDKNIYENTTSPGGGPLCG

EKTHRSDVIIPPPGFAPSTDTASNTLGENVDASATTSSANPLSQEPGWCESCSKLFKSQRGLRVHQRS

KHPELYHSQNQPLPRSKARWSDEEMVIFAREEIANRKIRFINQHLHKVFPHRTLESIKGLRGKNVRY

ARIMADLEAEMTSQPEAATSLCTETSENLASSNVLPQTRGWAENLVENIDTAHLANLGPLSQFEPGK

PSSSTKEAINTEYNDWISKWLPSGAAHRERRANPPSTKLNARATRRLQYSRIQNLYKLNRSACAQEV

LSGAWKVQSGELNLKEVQPFWEKMFRKESAKDRRKPKPTGEVLWGLMEPLTIAEVGSTLKSTTPSA

PGPDKLTLDGVKRIPIAELVSHYNLWLYAGYQPEGLREGITTLIPKIKGTRDPAKLRPITVSSFICRIFH

RCLAQRMETSLPLGERQKAFRKVDGICHNIWSLRSLIHNSKDNLKELNITFLDVRKAFDSISHKSLGI

AAARLGLPPPLITYISNLYPNCSTKLKVNGKISKPIEVRRGVRQGDPLSPLLFNAVMDWALSELDPRV

GVQIGEQRINHLAFADDIILVSSTKIGMVSSINTLSRHLAKSGLEISAGKEGKSASMAIVVDGKKKMW

TVDPLPRFKVNSQKIPALSITQQYKYLGINIDAQGARNDAARILTEGLAELSRAPLKPQQRLYLLRVH

LLPKLQHGLVLSSCAKRALTYLDKSVRSAIRRWLTLPKDTPTAFYHAKACDGGLGITRLEHTIPILKR

NRMMKLTLSEDPVIMELVKLTYFTNLLHKYSNVKLLNSWPVTDKDSLARAEASMLHTSVDGRGLS

NCSDVPRQSDWVTNGASLLSGRDFIGAIKVRGNLLPTKVSAARGRQREITCDCCRRPESLGHILQTC

PRTWGPRISRHDSLLKRVRNQACLKNWTPIIEPSIPTNIGLRRPDLVLAKGNIAFLVDATVVADNAN

MQLQHEAKVEKYNNSDIKEWIKVHCPGVDEVRVTSLTANWRGCLYGGSASFLTEDLGLPKAELSL

LSAKINEKGYYLWCAHYRGTARLWNRPLRS

AAB94032.1 reverse transcriptase domain protein, partial [*Drosophila mercatorum*];
SEQ ID NO: 11

FERRTGPVGYLPSGIEKLMVQMFNNEPRIAENNSVEYTPTVTRLGDHQVRNADANLQTMFPCRECE

RSFRTKIGLGVHMRHRHKDELDTARRRVDVKARWNEEELSMMARKELELTANGERFINKKLAEIFT

NRSVDAIKKCRQRDNYKAKIEQLQGQAALISEANEPPTTQRRPSLSELEVTPSSSHSVPIAPPPIHSDDI

LLQELQGMSPVAVRRSWRVEVLQSIIDRAHISGKEATLQCLSNYLLEIFPNRNDRPSSATVPARRPRN

```
RRISRRQQYARCIKSLLDGTDESALPNQSIMEPYWRQVMTQPSPSLCSNTVPRKGNMQEGVWSPITS

RDLQVHKVPLTSSPGPDGITSQTARSIPIGIMLRIVNLILWCGDLPVPFRMARTIFIPKTVRANRPQDFR

PISVPSIVVRQLNAILASRLTAAVSWDPRQRGFLPTDGCADNATIVDLVLRDHHKRYASCYIATLDV

SKAFDSVAHDAVFNTVTAYGAPKSFVDYVRRWYSGGGTYFNGGDWRSEEFVPARGVKQGDPLSP

VLFNLIIDRLLRSLPKDIGVHVGNAKVNACAFADDLMLFASTPKGLQELLNTTVKFLSSVGLTLNAD

KCFTISIKGQPKQKVTVVEQRTFCIGRARVQLKRSEEWKYLGIHFTADGRARYNPSEDIGPKLERLM

QSPLKPQQKLFALRTVLVPQLYHKLTLGSVALGVLRKCDKLVRSFARKLLGLPLDVSVAFYHAPHS

CGGLGIPSVRWIAPMLRTKRLAGINWPHLEQSEVASAFLSEELRRARDRAKAGVNELLSQPKIDTY

WADRLYTSVDGNGLREARRYAPQHGWVSQPTRLMSGKAYRTGIQLRINALPTRSRTTRGRHEMNR

QCRAGCDAPSHNHVLQRCHRTHGSRVSRHNGVVSYLKKGLETRGYTVYSEQSLHGQNRVYKPDIV

AFRHDSTIVVDAQVVTDGLDLDRAHQSKVEIYNRQDLLTTLRSVYRARENIEVVSATLNWRGIWSF

QSITRLRTLGILTAGDSNVISSRVVSGRVYSFKTFMFHAGFHRGMA
```

AAC34906.1 reverse transcriptase, partial [*Forficula auricularia*];      SEQ ID NO: 12

```
LGPRSINQPRIRTDSPNIVRPSGSTTTMQRCTTSDLTFSQCRFPHCKFRRPSLTGVRVHEQRSHKAFFD

RLQAEVIRNQTSKKKPRWTEEEKNLLALAQANLIIEEETNIIDDLVSKFTYRTKDALKSQIRKPEHKT

RVSEFTLAIQAHIDNIMLPAPVPIATDPLQVSCNFKDRAKDYIDTLEPITSTKFYLDELEALCDNICIWP

TRLLITTVESYIRKLFKTTSTLKPAQKLHNPSNRNLPKRQLRRMEYGKTQKLWKKNPCRAIKTIIDDK

DCKSPPEREAMTQYWKTTFSSKKRTCPQYEPRESTKTQLWEPVTIEELHCCHLEMTTSPGPDGITVR

QLYLVPEQLLVRILNLLMACGKMPDSFLESKTTLIPKKPNSTEPGDFRPITVQSVLVRQLNKILAARV

AQHIPLDERQRGFRPVDGVAHNIFELDMILRCHRSEFRDLRLASLDIAKAFDSITHNTIEDTMEVRGF

PKPMINYIMACYRRSKTRFTFNGWISDTVKPTCGVKQGDPLSPILFNLVMDRMIRKLPKEVGVNVGS

KHYNGLTFADDLLLFATTPEGLQSSIDIVHLFLLECGLLINKQKSFVLTVKAYPKLKKTAVIVTEKYM

LDRHILPAIDREKLFHYLGVPFTAEGRCRDDTIAHLKRKIDVLTKAPLKPQQRLFALRVVILPSCYHIL

TLGGSNLSLLKKIDLMVRAAGRKWCCLPKDTPNAYFHASSRDGGLGLPSMRWLIPLHRYLRLLRYE

GRNPEDTNVYLTTEINRAKIRLSDNGSNIDCQAKLWQFWADRLYKSVDGSALIESSKVPQQHRWAT

GGSRFLTGRDFINSIKLRINTLPTLSRTLRGREGNRMCRGGCYNVETLHHVLQVCHRTNGTRVKRHN

AIRQYIARGAAVKFDTVEREPRIKSASGAVNIPDLVACNSDEVVVIDTQIVWDQANLDEAHQAKAE

KYAHLSDILKHKYSRDRVKFTSVTLSFRGLWSKQSLKELTDLGIVNSKDIQIISTRAIIGGIASFRMFN

STTSVNSVNSFLEIALG
```

BAC82589.1 reverse transcriptase [*Ciona intestinalis*];      SEQ ID NO: 13

```
MPGCQSVVGSECSQCGRVFKTARGLSVHRRSKHPEAYHREHIAAPRVKARWSEEEMILMAQXEVQ

APAGTRFINQYLHALFPSRSLDAIKGARGKSAAYKKIILEQRLAALVPVSPPNQISGAESPSQPSNTSQ

EVRQDPEERSLRLRDAIDLGHLRTDFDMTAVNPGHPDPVIREEIDREFLRWLEPNRRRRGYAKATRI

ALNAPGKVRRRAEYAAMQRQWKTKRGLCAREALEGTWKIPARTVSLSDQEAFWRPLMESQSKND

LREPAKVGETLWGLLDPITPDEVRQILGSMSSKAPGPDGHRLSDLRSIPIDQICSHFNLWLLAGYQPK

ALRMGESCLIPKVKDASRPQQFRPITLGSYVGRCLHKCLASRFERDLPISIRQKAFRCMDGVAENVM

ILRSVLDDHKKRLAELNLVFLDVSKAFDSVSHRSILHAVKRLGVPPPLLKYVEELYADSETFLRGSG

ELSPSIKVRRGVKQGEPLSPHLFNAVIDWALSSLDQSFGVTVGEARVNHLAFADDIVLLSSSQPGLQR

LIDQLTTHLGESGLRVNSTKSASIRIAVDGKNKRWVVDPRDSVHVGGVRIPAVAVSGSYRYLGVNIS

AAGMRVDAADSLASKLANLSRAPLKPQQRLYILCTHLLPSIYHQLVLSSTSKKFLKYLDRCVRVAV

RRWLRLPKDTPKAYFHAKCNDGGLGVPELQRVIPLQKAGRWLKMTRSQDPVVQAAVGLEYFQKL
```

LERWSTPELYQWGGGGITTSGHLAVAQARSLYSSVNGRGLRQSGLVSTQFDWVRSGCSLLSGRNFI

GAMQLRGNLLATKLRASRGRPRVDISCDCCRTPESSGHILQVCPRTSWGARIGRHDNVAKLVARES

AKRHWKVIREPAIPTPAGIRRPDLVFSKGDTAIVVDVTIVPDNAELSDAHSSKVSYYDNGAIRGWVA

LNTGASHITFSSVNNNWSDCMAEESKRMLKLGLGLPNSIRGTISAVVLEKGFHMYLCFKRGTFRASY

AIL01110.1 reverse transcriptase [*Bacillus rossius*]; SEQ ID NO: 14

MLASSFKKKPRMVSSSKSGSSCNDAPTGVVVPASKESVESPSLDKKVGYGCEFPGCPRVFTTKTGR

GVHHRKAHEDWYDARQKLDYVKARWTREESALMAREEAKAGTQSAKKMNQVLQLVLPDRTLES

IKSHRRSAQYKELVLQAMGALSDSGKCAGPSQLANAELSTPLSSAVLGXGEPGGGGSGEHGSGDVP

GSSRGEHLSALLDGLQPGPVVDRLRLIVRSVDDWSRARLHQEIGWFLRDLFWKPLTPNLARVSLPSK

DKVSRRRLRRADYGRVQRAWKRNRNTCLRDLLRDKRTESAPPEELXVPYWESVLRSGSSCTPGQR

GRTAERTELWDPVSSKEVEQALPPLGTAPGPDSFTPKDFRAVPSAVWACIFNIFMLCGRLPDYLLES

RTTLIPKRDGACNPEDFRPITVSSVVVRCFHKVIANRMSRHIQLDPRQKAFRSLDGCSEGVFLLDFIL

GHARRNHRPVHLASLDVAKAFDSVSHAAILDVLRSFGVPDQMVEYIASVYAGSRTRLQGDGWQSH

AIHPTCGVKQGDPLSPMIFNMVIDRLFTLFPRDTGVSVGDTVLNGMYADDLVLFATTPVGLQQLL

DITAEYLSQCGLRVNAAKCFSVSLAIVPHEKKVVVATKHRFKCLGQPIPALKRSDQWKYLGVPFSPE

GRLKIDPLGRLKDELEKLRRAPLKPQQRLYALRTVVVPGLYHLLVLGGTTISSLNRLDIAVRSTVRK

WLSLPHDVPNAYIHADARDGGLSIPSYRWTVPRLRFHRLKALSVLCDGGGPDEMVACVGDEIKRAS

ARLQDHGMNINTRNTYRVRFARLLHTSNDGAPLKGSKKVEGQHRWVTDGSLMLSGRDYIACNWV

RINSIPLRKRTARGRVRDTRCRAGCDSTETLHHVLQQCHRTHDMRIKRHNACVKYLLDRQRSRGKT

VFWEPHFHTAGGLLKPDSVILHDASTAVVVDALVAGERSDLDREHDRKVSKYEPLVDLVKDRYSV

DKVIFSSLIISARGVWGGRSFRHLSKLRLLDISDAKVLSTRVLLGGMGAVRVFNRRTAVSGRVNGW

AF019998.1 R2 protein [*Lepidurus couesii*]; SEQ ID NO: 15

MSGKSSKPRTVSSGSSSQETPPSGSNACDICGKCFMKPVGLSLHMSKVHPTQYHARLEKNQPKAKK

FRWTDEDLYFLAKKEAELLLLGGIKFMNKELAEFFPEKSVDQIKGQRRSETYKQQVVSIHSELLKLQ

AVADSPPPSRIPAKEVSAWLDFLLALPKTKNKFSEDKLDQLIRTAQEGTPVLNDLDLYLREVLVQPT

RQGERQAKPLPPPKSSREKRDREYARVQNFYRKNKTACVNAILDGNKKCENKIPDIDEFWKAIFESQ

SPPDAEPVSYVVDEEPKNIWSWISFFEMNRNYPDTSTSPGPDGVTARMLRSIPARVLNKLLNLLLFIE

DLPAVFKCHRTVLIPKVDNPALPGEFRPITISSIIVRQLNKIIAARVSEGVPINPRQKAFRQIDGCAENV

FLLDFILRDAKTKIKSLSLATVDIKKAFDSVSHHSIFRAIRGARCPENLVNYIQNSYSGCTTQISVGGSI

STTKILMNRGVKQGDPLSPVLFNLVINEIIRKLPASIGYPINSELSINCIAYADDLILVANTREGLKLLL

NLLNEELPKRGLELNASKCFGLSLTALGKLKKTHLCTSDQLDLHGTLIKNLTAEESWVYLGVPFSHI

GRSKSFSPDLEALLNKLQKSPLKLQQKLFALRVYLIPRLLHGLVLSRVAIGELKIMDKLILKHLRVWL

RLPKDTPLGFFYSPVKLGGLGIKNLRTNVLKCRKQRIERMLVSPDDVVRLVAESEIFLKETDKLKDL

LTINGMCLDXRNVPRTGKNNKFWSERLYTSFDGKTLAYSEYFTQGGGWIREDKILQPAHVFAECIK

LRINALPTKSRVAHGRPTKDRSCRAGCLDVQKVPAIETINHIAQVCPRTHGARIKRHDRLVQFLSLNL

RKNPKRNVLVEYNFRTVAGIRKPDIIVIEDTRAAILDVQVVGDSSNLEMEYLEKSRKYSNDATLSMR

INALQKLYPTVTSLTFHAVTFNNRGLIAKSTVAALRMLGVPPRCIMILCVISLEKTLEVWRMFNQST

ASARK

KMQ88340.1 reverse transcriptase [*Lasius niger*];　　　　　　　　　　　　　　　　　　　SEQ ID NO: 16

MGGSPPASFRRRPGKEGIPAPPGPWGCQPLGLVLVGPKNRNQASDNSGGPSGPSAPANPPSQVDDA

DFRCEFPGCNRTFPTNRGRGVHHQRAHKDWFDARLQPAVDKVRWTAEETAMLARKEAELTVESN

PRFINQELLQYFPQRTLEAIKGKRRNQEYRELVEEFVEEFRNPDVITIEDDEEDEEDQRDIFLDYLESL

TRPQGREFQATRLHNIAMEARTSGKDATLQKIALYLREVFPAPPPRRERRRKKTPNPAPMRKREARR

CEYGAAQSLWKRDRRHCITNILNEMGPVNQPPRETMEPYWTRMMTTDGRTSPPSDKVPIKEDIWTP

ITGNDIKRSRIPRASAPGPDGISARLYRSIPTTVIIRLFNLLLWCERLPEDLLLSRTIFLPKKTNASEPGD

FRPITIPPVLVRGLHKILAKRLETALDIDPRQRAFRSMDGCADNTLLLDTLLRYHRKQYKSLYMASID

VSKAFDAVTHPTIESTLISLGVPPPMIRYLGQVYANSRTRIEGDGWTSKPVHPKRGVRQGDPLSPILF

NAVTHRLLQRLPREVGARLGNIPINAAAYADDLLLFASTSMGLQQMIDTMTDYLAECGMTINVEKS

MTVAIRAAPHLKKTAVDASLSFSCGGRQLPSLKRTNKWRYLGVVFTPEGRAQCRPAEVVAPLLGAL

TKAPLKPQQRLYALRTVVIPKLYHQLALGAVTIGTLNKTDRLVRGALRKWLALPHDTPNAYFHTSV

RDGGLGIPAIRWTAPVQRRGRLLGVMKALGQQGLDRFIQDELNTCKKRLTDHGVLLGTPEMVAKR

WAQQLYGSIDGAGLKDSAKTPHQHQWIADGSKFLTGKDFINCNRARIGALPTRSRTTRGRPQDRRC

RGGCLAQETLNHVLQHCHRTHGQRIKRHDAVVKYIARNMPRSGYEVHQEPHYKTELGLRKPDLVA

VLGQTAIIIDAQVVSEQTNLDDAHTRKVAYYNEPATIRAIKAEHGVRTVKVTSATLSWKGVWSPRS

AEELRKLGFIRAGDAKVVATRVLIGNIAAFRTFNATTSVEHRAGIG

AF019997.1 R2 protein [*Lepidurus couesii*];　　　　　　　　　　　　　　　　　　　　SEQ ID NO: 17

MSEESRPKQTASKRGAAVEKTMMSGTYVCTLCGRSFEKSVGLSLHTNRMHPEAYNKLKEAKKPVL

KKARWSEEEVFLLAQKEAELSFIGGIKFMNIELHKIFPERELEGIKGQRKNPTYKAQVVSLLAEIRES

KANDSSSSSSSSSCDSASLGISNWLEFLLALPKTSNQFQEGRLDRLISDALRGVDVLENLDAYLLEV

FAKPMAQNPCPKPPPPAKNSRERRDREYSRVQNFYKKNRSACINSILDGNTRSQNVIPGLTKFWTET

FEKNSPPDDEAPDQFVADEPRDMYKWITFYEMSQDYLDSSTAPGVDGFSAKQLRSMSPRVLNKILN

LLLLSENLPNSFKMHKTVLIPKIDDPKSPGDFRPITISPVLARLLNKILAARLSKLVPISQRQKAFLPVD

GCGENIFLLDYILRSSKKSSKSVAMAVLDVKKAFDSVSHHSILRALNEAKCPINFINFVRNSYDGCTT

KLTCGGTSFPDSVRMNRGVKQGDPLSPVLFNLIIDSAIRKLPDSIGYVIRDGLKINCLAYADDLILVAS

SRAGLKTLLNIVAEHLSRGLDLNAAKCHGLSIIASGKAKTTYVSAADSLDLDGQPIKNLGVLDTWT

YLGIPFSHLGRAEKVSPDLTNLLNKLQKAPLKLQQKLYAVRNFVIPRALHGLILSKTNLKELNTLDR

AIRVFLRTLLYLPKDTPLGFFHSPIKSGGLGITCFRTSVLKCRLQRIARMRSSCDGVIQAVAESDIFAD

EYAKLRDLIRTNGNVLDTTESIKRYWAQRLHSSVDGKTLAYMDYFPQGNLWMSEDKVSQRSYVFA

DCVKLRINAIPTRVRVSRGRPNKEMCCRAKCFDSQRMPAFESLNHITQVCPRTHGSRIQRHDKIAKF

LFKNLNNCPSRSVLYEPHFVTVDGLRKPDIIIYDDSHMVVLDVQVVSDSANLEKEFECKAKKYAND

VALRSAMLIKYPFIKSFSFVAATYNNRGLIAKSSVQVLRQLGLSPRSIMVSILICLEGTLETWRIFNQS

TMNAH

AAC34903.1 reverse transcriptase, partial [*Anurida maritima*];　　　　　　　　　　SEQ ID NO: 18

VGVQGEVTSLRLLCQQDSEVYATTMNRKNNYTRGNRFSSGSPGNFVVVRDPAQDLPFKCAFCERTF

TTSNGKGLHELRSHPKEYNMRVPVAKKRARWSEEELSQLAEAEHDLKSKKQYASELDLSRDLEGC

MVGRSLESIRGQRKLPRYVEIFNRLSNSRASIPEIGEGDEEANSVGSDEVFHASGHGTGITEALEVLVS

KRPGEAFREEVLNGIVRAKLEGSEVFVRLEQYLSRMFVGQSSLASTPCSSGEGKLPLTCSGSNKKEQ

RSDLFSRFPEKGPSVSVSAPSVSDMGRKRRKALSRNEATQVREEFVEFARNVDPIPRRKCARVNEGL

-continued

QGNQRLPKEKPMTARAKMRHLRLLRYRRLQELYKKDRSLAAKQVLQDMLDSKPGRNPEAVKYW

AETMGKESTGIDVSVMTGRPRYRDNVWSPIYPGEVSAAVKLMDSSGATGPDGFSVRSLKCTPSRVL

AKVFNLFLLEEKLPAFLMTSRTVLVPKVKEPKAPTDYRPISVSSTLVRLFHKILARRLTLASGLDSRQ

RGFVPVDGCAENLVVLESAIRSAKNYKRSLFVASMDIKNAFGSVAHEAIFEALSKSGAPDSFVTYVR

NCYDGFASVVKLGRDTAQTTVRQGVLQGDPLSPILFNLVIDQIIRSLPETVGVQLDANTKLNSMAFA

DDLILLSSSEAGMRRMLGVLAGVSSKFGLIFHPGKCKYLAMIWAGKQKMKIATDLSFEIGGGFMT

PVGVTETWKYLGAYLGQIGIQPARLSLQTFLERIAKSPLKPQQKLYLIRVHLLPKLIYPLVMAPIRAS

MLNKLDRMVRVALTGKDGILHLPQSVPSAFFYAPIGEGGLGLMELRTSIPAMVKARFERMMNSTCH

HVRAAAKGAANSNRIALANRFLRKTADGIPVTSAKLVKEYQAAKLHGSFDGKPLSEAGRVKGIHS

WTCDGRMVMTGQAFCEALKIRINALPCLSRYNRGTEKPRECRAGCKTTESLNHVLQVCPRTHDMR

VARHDKLVNRLGGYLSQKGFEIHTEPRIITSLGLRKPDIIAIKGEKGVVLDAQIGGAANLNAAHDAK

MCYYSSSPEIKEWVTGKGAPDVSYGACIVSPQGIMSEESWKTLRGLGFSKGMLNSLVVTVMEQSTY

VWHVFNRSTASYGWKRRRKRKWD

AF019995.1 R2 protein [Lepidurus apus lubbocki]; SEQ ID NO: 19

MSEESRPKQTASKSGAAVEKTMMSGTYVCTLCGRRFEKSVGLTLHTNRMHPEAYNKLKEAKKPVL

KKARWSEEEVFLLAQKEAELSFIGGIKFMNIELHKIFPERELEGIKGQRKNPTYKAQVVSLFAEIRESK

ANDSSSSVSSSSSVDSASMGISNWLEFLLALPKTSNQFQEGRLDRLITDALQGDDVLLNLDAYLLEV

FAKPMAPNPCPKPLPPVKNSREKRDREYSRVQNFYKKNRSACINSILDGNTRSQNVIPDLMKFWTET

FEKVSPADDKAPDQFVVDEPRDMYKWITFYEMSQNYLDPSTAPGVDGFSAKQLRSMTPRVLNKILN

LLLLCENLPNSFKMHKTVLIPKIVDPKSPGDFRPITISPVLARHLNKILAARLSKLVPISQRQKAFLPVB

GCGENIFLLDYILXNSKKKSKSVVMAVLDVKXAFDSVSHHSILRALNEAKCPVNLXNFVRNSYDGC

TTKLTCGGTSSPDSVRMNRGVKQXXPLSPVLFNLIIDSAIRKLPDSIXYLIRDGLKINCLAYADDLILV

ASTRAGLKTLLNIVAEHLSRGLDLNAAKCHGLSIIASGKAKTTYVXALESLDLDGQPIKNLRVLDT

WTYLGIPFSHLGRAXKFSPDLSNLLNKLQKAPLKIQQKLYAVRNFIIPRALHGLILSRTNLKELNTLD

RAIRVFIRTLLHLPKDTPLGFFXAPIKTGGLGITCFRTTVLKCRLQRIARMRNCSDEVLEAXAESDTFD

DXYAKLRDLIRIXGNVXDTTENIKKYWAQRLHSSVDGKTLAYMDYFXQGNLWMSEDKVSQRSYIF

ADCVKLRINAIPTRVRVSRGRPNKEMSCRAKCLDAQRIPAFESLNHITQVCPRTHGSRXQRHDRXAK

FLFKNLNNCXSRKILYEPHFMTANGLRKIDIIIYDDSHLVVLDVQVVSESANLEKEFTCKAEKYAND

VALRSAILLKIXIY

BAC82591.1 reverse transcriptase, partial [Ciona intestinalis]; SEQ ID NO: 20

KFKQSKVKHNQKENKSKRQIRRAQYARTQINYKRNRQQAINSILSKQWRELDDRGPPLEHVLPFWQ

KLLEKSSEHDTRQPEPVSGPIWELVEPIVAEEVRLVRKSMPTSAPGPDGIRHKDFMAVQPQILADNFN

LWLLTGYQPKSCRLGRTILIPKEPGTRDPAKHRPITINSLLIRCFHKILSNRIMKLIPLSPQQKAFRPGD

GIAEHIWNLRHILNQHKLEKKELNLAFLDVRKAFDSVNHSTLLLAAGRLGVPPPLLKYIENLYEGSS

TTIIANGERSPRIRVRRGIKQGDPLSIPLFLGVMDWAMSNLNPNVGSSIGGKSINCMAFADDLVLISRT

QIGLQTNLDTISYNLNQSGMTLNSEKCATLRLAVDGKSKKWWIDHRPFLRVEGAKCGAMDIEGTY

KYLGVRVGAGDTRAECKEKLMSDLKETTEAPLKPQQRIFILRNYILPRSLHILTFTNTTARLLKQLDS

AIRIHVRRWLKLPKDTPLGYLYSDYKDGGLGVPRLLSRVPLLRIRRMAKYNTSEDPTTVALRSCHTF

TSAAVKWAMPPKISNVVISDKRKERDFHRSELATSIDGSGLSCANTTPRAHQWVVNGTGLLSGKNY

IGAINARGNLLHTASRAARGRPQRTTDCDSCHRVETLSHILQSCPRTHGPRIRRHDKVTKVIAEAAG

KKGWKTIAEPRIPTPEGIRKPDLILYQHGRAIVMDTTIVSDSADLSMSHQHKVIYYQNECIRSWVQEA

TGATEVTWSSFSANWRGCIADESRDLLLHDSTSQKTAA

CAX83712.1 endonuclease-reverse transcriptase [*Schistosoma japonicum*];　　　　　　　　　　　SEQ ID NO: 21

MSAMLNITTECHPVSTGVNADPSFSYSSTCLCCFSSFASNSLLLDHATASHSANIVSPPSESGSFQLVC

MLCSSHYLSSRGFTQHLRHVHPDAYNSLKCLRLNASPLTHRSWSSEEDVCLLSRADELSASCRLKV

DLYNRLHTVFPSRSPEAIKKRLRFLSSSSESSSSAPSPSDISSAASSVSSLPVDLDAPTRSLIPTRRPARS

HSSSILSFFTRTPRDVSSSASPVVLHSSPSTTIVINNASVRLHLDSPVSSHALESSCMSSLATNPLHIIDN

QHLAASPPLSGVHCPSVPSSAPAAAHVDQSFDNPALGSTPVDSCPPVTSLTLLPAQLSDVAVNLMTS

CPELIKPASPSPPLMDDNLLQLILPSDSPNMSPHIVPPPDVVVAPMCTDSTRELISAALRLITQNSPLM

HAPTLREFLQAALVNMPDMIEIQLFLNSHAELQFPTKWRPSKPRLPPTYRANTSRKHLRRLQYGHIQ

TLYNRCRRDAANTVLDGRWRSPHTSSPFSIPEFETFWKTIFTTPSTPDNRPVVPVLPTCPALLDPITPD

EITWALKDMRNSAPGVDRLSAQHFLNFDVPSLAGYLNMVLAFKFLPTNLSISRVTFIPKGASPQQPN

DFRPISIAPVITRCLHKILAKRWMPLFPSSKLQFAFLQRDGCFEAINLLHSLLRHAHERHSGCSIALLDI

SRAFDSVSHHSILRAAHRFGAPDGLCQYLQRVYNGSTSLFNTVDCAPSRGVKQGDPLSPLLFIMSLD

EALESIETVSPVIVDGLPISYIAYADDLVILAPNADLLQKKLDKLASLLQRSGLIINTSKSMSIDLIAGG

HSKLTALKPTVFKIDGNQLQRLNVSDHFDFLGISFDYKGRSKMDHVETLSAYLLNLTQAPLKPQQR

MSILRENLEPRLLYPLTIGVVHKCTLRQMDCLIRSSVRKWLRLPSDTPTSFFHSSISTGGLGIPHLSSIIP

LHRRKRAAKLLLSPCPIIRWVSQSPSFSNFLRICNLPINVHRDLIHSFDEARCSWSKQLHSTCDGRGLS

MSSRNTVSHLWLRYPEHIFPRLYINAIKLRGGLLSTKVRRSRGRQENADLLCRGRCGHHESIQHILQH

CSLTHDIRCRRHNDICRLVASRLRRNNIRFFQEPCIPTPVSFCKPDFIIIRDSIAYVLDVSVCDDANVHL

SRQLKINKYGCSTVVSSIYNFLNATGLRISSVRQTPLIITYRGLIDPLSTTSLRRLSFSSRDISDLCVASI

QGSMRIYNTYMRGTSPQDP

XP_009165216.1 hypothetical protein T265_13057,
partial [*Opisthorchis viverrini*];　　　　　　　　　　　SEQ ID NO: 22

VLVTFDNVYYESSGASAPVPTSTQERLVGFTCEECGKCCKSKAGFVAHHRVHDNESVGTNTVAQL

ACADCSRLFPTKIGLSQHRRHAHPTQHNADKLGRVKYSGTRWSQQESQSLLRLANNLYPSCGTQTE

LFTRLEQYFPGLSAISIETRLRVLNWQAQQDESSSGEPERIIGLTTADSSEADGYNVWFKQTVDCTVS

LLESHAHRALASVDLLAFARGLQSGIMTPEQVLSLLDLHAFRTFPHTWKTVSRRRQLAHRIPVNRK

QIRRANFAAIQTLFHQRRKDSASAVLDGSWRDLYKGNCGLPTNAERPWKQVLSAPKRAGSRPSRIV

VPSDWSLVEPITGEEVGRTIRLMGNSSPGLDKLTPRTLRRFNANVLAGYFNLFLLSGGCPPHLCRARI

TLVPKVPHPTSPDQLRPISVSSILVRCFHKFAFLHRDGCLEATSLLHALLRHSSATASNLSLAFVDISK

AFDSVSHDTIVRSAKAFGAPSPLVRYIAQSYENAVAVFPSSEVHCHRGVRQGDPLSPLLFIMAMDEV

LGLSMPQLGYQFHDTLVDGFAFADDWVVCAESQARLKEKLEAAAVELGRAGMKINARKTKVMVI

CGDRKHRATAVSVEPFRFAEELITPLGPTDTVTYLGIPFTSKGKGVFNHRQHLLKLLEEVTRAPLKPH

QRMDITRNYLIPRLTYSLVLGQVHRNTLKRLDNYIRQYIRGWLRLPKDTPISYIHAGKQHGGLGIPSL

SATIPMQRKTRMEKLLSTQCRVLRNVVNDSAFGKIVRDLSLPIRVHGACVNTKEELVAAWGESLHN

SADGRGLRELVTSPLSNRWLVFPERVFPRIFIRGIQLRCNLLRTRVRSARHGHGGQTILCRGNCGQPE

SLVHILQSCWITHDARCARHNRVARELAKRLRRLGYTVFEELRAPTSTSFIKPDLIAVRDRRATVIDV

SIVSDGRGVIVWNEKKQKYGADEHSLAIISALHAIGCDINFSVHQPMIISYRGICFPQSAKAVIGLGLL

RSDVSLFSPIFPRYSFTFKTRIHFLSQVGKTTLILSLVSEEFSPKVPAQAEEITIPADVTPERVPTQIVDY

SSRTQSHEQLCAEIRRADVICLVHALDDEKSLERISSYWLPLIRHNGANPDCHSPIVLVGNKLDLLNE

SKLSKALPIMSEFSEVETCIECSAKTLLNLSETFWFAQKAVLYPTAPLYDAERKELTPACIRALTRVF
RICDTDNDGYLSDRELEAFQSRCFSVPLTTQSLQDVKQLVRQSCPGGVTLNGITQKGFLFLHLIFVQK
GRHETTWTVLRQFGYDNQIRLSNEFLFPRFSVPSGCSTELSTLGIQFLHMLFNKYDLDRDGCLSPSEL
SEMLAIFPEDQLSHVSELTDSVTTNSTGWITCQGFLAYWALTAYLEPTRVLEYFAHLGFTYFAAGSF
WSTVNSHHQQQQHPKDPYDGTPSTPLLIGALPLRDRLIGQNPPNSSGRSDAGGSSVPMSRNTRDALL
RSLVITSEKRLDTIRRSTQRTVFYCRVYGARKVGKTCLLQGLLGRHLRGTGGLAIGGLSGRSSGWAA
ATGIQVYGQQRTLIMHEIGAAGGEQXXXXGGPRRIQVYGQQRTLIMHEIGAAGGEQMTAGEALSA
DVACLVYDVSDSDSFRYVANLFLNYYRGTRVPCLFVESKSDQPRVVQNYQVDPIELTTKYNLNPPE
PFSSMNLEQCLNALASNSTRNVASSLGDPVSRSRSATNLFPNPMPSRRAGSLEPSSSTAGGETHLLKD
SSHKLSPGIGLSLLSLEKESVQLNPPLDARGRRHSKPDLAYRPSMEFSARDTNFLPVYVTLCTLANYP
HLRGLQLAQTDYAWKWTLAATILAGFGFVAFRIAKTHF

AAB94040.1 reverse transcriptase, partial [Hippodamia convergens];
SEQ ID NO: 23
AFADDVILCGTTSWGLQRNLEIFEEELRRSGLSLNPGKSKCVSLVASGREKKVKLVMTPTFRASGSW
LSQVDGTTFWKYLGLQFRGCGMAGCGSDDVAECLERLTRAPLKPQQRMHLLRVFLLPRFYHVWTF
GRLNAGILRRLDIRVRNAIRTSVRLPHDVPVGYFHAPTNAGGLGIPQLSRFIPLLRLKRFERLAHSSVE
SVRECARTEPAVAKVRWCRERLADVVDRVADGTQSLREFWTRELYRSMDGRALRESVRETPSTQ
WLRCCTRVIPARDWLNYISVHINALPSRVRTSRGRRDGVDVTCRGGCLTAETPAHCIQVCHRTHGG
RVLRHDAIAKALSVHLTQRGWSVRREVSYQTVVGVRRPDIVLLAGREIAVVDVQVVAPNPSLDSAH
RKKVAKYRDEAQLATCLVRGASVQPRRRAEEETQVRFASATISWRGVWSSESARSLRELGLTDREL
AQYSTYDLRGSWMNWVRFGASTSTRMAWRP AAV85443.1 reverse transcriptase-like protein, partial [Amblyomma americanum];
SEQ ID NO: 24
PLFFNLVIDEFLEGLNHELAYRCQGLQVSAMAFADDLILAASTKDGLKEHTRKLENFLSQRGLRAN
AEKSSTLVILPSGRGHKSKICPNITFQIHGKDMTSQNCTSLWRYLGVTFSATGRIQGPIRFELAALLQR
VSSAPLKPQQRLVVLRYYLMPRLTHRLTLGPISAKTLTAIDRTIRSNIRRWLALPLDVPMGFFYAQIE
QGGLGINCLRTTIPSLRLRRFAKMTHSSNSACTFAATRRTVTDSIHQAERLCVFKGQTLRNPKESGRF
WSSQLHASSDGRSLQGCKNAKGSTYWLREGTSFLKGREFIDLTKFHTGAMPNLTRLKRGRDVPKK
CRAGCESEESMGHIQQRCHRTHHTRIERRNNLVKYLSKRLHDLGWHVKVEPHYATSQGTRIPDLVI
KRDSQALILDVQVVGTRVGLTQAHEAKTNKYKIPELLMSMDPRPSVSSVTTSYRGVWATQSVGILT
DIGLGIHDFKIMTIRCLQGGLRSFRTHQQMTSVRRDGNFRAV AAV85445.1 reverse transcriptase-like protein, partial [Ixodes scapularis];
SEQ ID NO: 25
PLLFNLVVDEFLQTLDPGIGYSSDQLQLDGMAFADDLIVFASTPEGLQRRLDSLHSFVGARGLAINA
EKSFTVSIVPSGREKRTKVVTTGNFSVSGIPLPACGIEARWKYLGVEFSPNGRNVPLTKDVASMLER
VAKAPLKPQQRVILRFYLIPRLYHRLVLGRWNRKLLKRLDVQIRDAVRKWMALPHDTPLGYYHA
PVAEGGLGVGSFSTAIPWMQVQRLPRMATSSSPICRQAADTYMVKTALDRAKKACVVRGNILSDK
QSVGKHWSALLHASNDGHALREVGRSPAAQRWVQEGTGLLTGRAFIDVNKLRINALPVRTRTKRG
RDTDKNCRGGCRAPETLDHVLQKCHRTHAARIKRHDGLVQIVVDRLRKKGWTVEVEKRFNGPQTL
IPDIVARRVLRENTPLEKRESAVIDATVITCGYPLLKAHESKVRKYDVPQVTSICKGKNTEHPLVTSA
TLNFRGVWCKQSAQDLLSLGLTKQDLKIMTVRCLQGGIHCFRVHHGMTSVK KRY44798.1 Retrovirus-related Pol polyprotein from type-2 retrotransposable
element R2DM [*Trichinella britovi*];

SEQ ID NO: 26

MAHWYASLIRLIAAGTFIGERPANSENSQMPCHLISDATCGFSFATFSGLHLHRKRAHPDVFAAACG

KKTKVRWSNDEISLLATLEAGLDPACKNINQVLAERLMEYDITRGVEMIKGQRRKEQYKALVRQLR

SKSVTQQCVGFAGSMDSNVPVNDTTSSVASEVTITYPEYGAVMSCDLIKEATGMAMVDINELQSNI

RKVFSSGRKLPVKSRGARETVQKKMANPRVAKYKRFQRLFRSNRRKLASHIFDKASLEQFGGSIDE

ASDHLEKFLSRPRLESDSYSVINGNKSIGVAHPILAEEVELELKASRPTAVGPDGIALEDIKKLNSYDL

ASLFNLWLKAGDLPESVKASRTIFLPKSDGTTDISNCRPITIASALYRLFSKIITRRLAARLELNVRQK

AFRPEMNGVFENSAILYALIKDAKARSKEICITTLDLAKAFDTVPHSRIVRALRKNNVDPESVDLISK

MLTGTTYAEIKGLQGKPITIRNGVRQGDPLSPLLFSLFIDEIIGRLQACGPAYDFHGEKICILAFADDLT

LVADNAAGMKILLKAACDFLEESGMSLNAEKCRTLCISRSPRSRKTFVNPAAKFNISDWKTGISSEIP

SLCATDTFRFLGHTFDGEGKIHIDMEEIRSMLKSVRSAPLKPEQKVALIRSHLLPRLQFLFSTAEADSR

KAWLIDSIIRGCVKEILHSVKAGMCTEIFYIPSRDGGLGLTSLGEFSLFSRQKALAKMAGSSDPLSKR

VAEFFMERWNIARDPKVTEAARRVYQKKRYQRFFQTYQSGGWNEFSGNTIGNAWLTNGRARGRN

YVMAVKFRSNTAATRAENLRGRPGMKECRFCKSATETLAHICQKCPANHGLVIQRHNAVVSFLGE

VARKEGYQVMIEPKVSTPVGALKPDLLLIKADTAFIVDVGIAWEGGRPLKLVNKMKCDKYKIAIPAI

LETFHVGHAETYGVILGSRGCWLKSNDKALASIGLNITRKMKEHLSWLTFENTIRIYNSFMKN

AAV85444.1 reverse transcriptase-like protein, partial [*Rhipicephalus microplus*];

SEQ ID NO: 27

PLLFNLVIDEFLAELDPQLAFTSEGMKVSAMAFADDIILTTATHWGLKQQIDRLNSFLGARGLKINA

AKSTTLVIEPSGWQKRSKIRTDIDFFVNGERLATTNCTSTWRYLGVHFGVKGLEKGLVRRQLAILLE

RVSKAPLKPQQRLVVLRFYLLPRLYHRLVLGPILAKTLLTIDRVVRSAVRRWLALPLDAPLGFFYAA

VEEGGLGVPCFRTVVPAMRLRRYQTVAQSSNPACAFAATRPTITQLKRQADNLTIFKGTKIGNSKQS

RKYWARQLHMSFDGRPLQQCKEAPGSTSWLGNGTSLLRGREFIDLAKFHVAAVPNLTRLRRGRELP

KQCRAGCQAEESLGHILQRCHRTHHARIKRHDNILRYLAGRLTELGWQVQQERHFKTSQGTKIPDL

VIIKREKSHILDVQVVSTRVELTEAHHHKCDKYKIPDLLFQVSPTPTVSSVTLSYRGTWAGESVRTLQ

EVGLTRNDFKMMTIRCLQGGLAAFKMHQMSTAVVRRGVGSQG

KRX52183.1 Retrovirus-related Pol polyprotein from type-2 retrotransposable
element R2DM [*Trichinella* sp. T9];

SEQ ID NO: 28

MSNRLANTAAAGGVPEKNSGTLDIPGQPSSSGEKRAISYPGPFGCNSCSFTSTTWLSVELHFKSVHN

TREFVFLCSKCEKSWPSINSVASHYPRCKGSVKAAVVPSSLANTCTTCGSSFGTFSGLQLHRKRAHP

DVFAASCSKKTKARWSNDEFILLARLEAGLDPACKNINQVLAERLMGFNITRGVEMIKGQRRKDQY

KALVRQLRSNSETQQCVGLAGSMDSNVPVNDTTSSVASEVTITYPEYGAVMSCDLIKEATGMATVD

INELQSNIRKVFSSGRKLPMKVRGVRETVQKKMANPRVAKFKRFQRLFRSNRRKLASHIFDKASLEQ

FGGSIDEASDHLEKFLSRPRLESDSYSVISGDKSIGVAHPILAEDVELELKATRPTAVGPDGIGLEDIK

KLNTYDLASLFNIWLKAGDLPDSVKASRTIFLPKSDGTTDISNCRPITIASALYRLFSKIITRRLAARLE

LNVRQKAFRPEMNGVFENSAILYALIKDAKVRSKEICITTLDLAKAFDTVPHSRILRALRKNNVDPES

VDLISKMLTGTTYAEIKGLQGKPIIIRNGVRQGDPLSPLLFSLFIDEIIGRLQACGPAYDFHGEKICILAF

ADDLTLVADSAAGMKILLKAACDFLEESGMSLNAEKCRTLCISRSPRSRKTFVNPAAKFNISDWKTG

VSSEIPSLCATDTFRFLGHTFDGEGKIHIDTEEIRSMLKSVKSAPLKPEQKVALIRSHLLPRLQFLFSTA

EADSRKAWLIDSIIRGCVKEILHSVKAGMCTDIFYIPSRDGGLGFTSLGEFSLFSRQKALAKMAGSSD

PLSKLVAEFFIERWNIARDPKVIEAARRVYQKKRYQRFFQTYQSGGWSEFSGNTIGNAWLTNGRAR

-continued

GRNFIMAVKFRSNTAATRAENLRGRPGMKECRFCKSAIETLAHICQKCPANHGLVIQRHDAVVTFL

GEVARKEGYQVMIEPKVSTPVGALKPDLLLIKADTAFIVDVGIAWEGGRPLKLVNKMKCDKYKVAI

PAILETFHVGHAETYGVILGSRGCWLKSNDKALASIGLNITRRMKEHLSWLTFENTIRIYNSFMKN

KRX72028.1 Retrovirus-related Pol polyprotein from type-2 retrotransposable element R2DM [*Trichinella* sp. T6];

SEQ ID NO: 29

MSNRLADTDAAGGVPEKNSGALDIPGQPSSSGEKRAISYPGPFSCNLCSFTSTTWLSMELHFKSVHNI

REFVFLCSKCEKSKPSINSVASHYPRCKGSVKAAVVPSSLANTCTTCGSSFGTFGGLQLHRKRAHPD

VFAASCSKKTKARWSNDEFTLLATLEAGLDSACKNINQVLVERLMGYNITRSVEMIKGQRRKEQYK

ALVRQLRSKSETQQCVGFAGSMDSNVPVNVTTPSVVAEVAITYPEYGAVMSCDLIKQATGMAIVDI

NELQNNLRKVFSSGRNLPAKSHGVRESVPKKMANPRVAKFKRFQRLFRSNRRKLASHIFDKASLEQ

FGGSIDEASDHLEKFLSHPRLESDLYSAISGDNSIGIAHPILAEEVELELKATRPTAVGPDGIALEDIKR

LNPYDIASLFNLWLKAGDLPDSVKASRTIFLPKSDGTTDISNCRPITIASALYRLFSKIITRRLAAKLEL

NVRQKAFQPEMNGVFENTAILYALIKDAKVRSKEICITTLDLAKAFDTVPHSRILRALKKNNVDPES

VDLISKMLTGTTYAEIKGLKGKPITIRNGVRQGDPLSPLLFSLFIDEIIGRLQACGPAYDFHGEKICILA

FADDLTLVADSAAGMKILLKAACDFLAESGMSLNTEKCRTLCISRSPRSRKTFVNPAAKFIISDWKT

GVSSEIPSLCATDTFRFLGHTFDGEGKIHIDLEEIRSMVKSVKSAPLKPEQKVALIRSHLLPRLQFLFST

AEVDSRRAWLIDSIIRGCVKEILHSVKAGMCTDFFYIPSRDGGMGLTSLGEFSLFGRQKALAKMAGS

SDPLSKRVAEFFIERWNIARDPKVIEAARRVYQKKRYQRFFRTYQSGGWNEFSGNTIGNAWLTNGR

ARGRNFIMAVKFRSNTAATRAENLRGRLGMKECRFCKSATETLAHICQRCPANHGLVIQRHNAVVT

FLGEMARKEGYQVMIEPKVSTPVGALKPDLLLIKADSAFIVDVGIAWEGGRPLKLVSKMKCDKYKI

AIPAILETFHVGHAETYGVILGSRGCWLKSNDKALASIGLNITRKMKEHLSWLTFENTIRINNSQMPR

HLISDAYEWINKIPSVPIYYLAKPQPRERAWQNQRGKKTLLSLTLV

AF019999.1 R2 protein, partial [*Lepidurus couesii*];

SEQ ID NO: 30

KQGDPLSPVLFNLVINEIIRKLPASIGFPINDKLSINCIAYADDLILVANTREGLKRLLEILNEELPKRGL

ELNASKCFGLSLTALGKMKKTYLCSSSHLDLHGTLIKNLTADESWVYLGVPFSHIGRSKSFSPDLEA

LLNKLQKSPLKLQQKLFALRVYLIPRVLHGLVLSKVAMGELKIMDKLILKYLRLWLRLPKDTPLGFF

YASVKLGGLGIKNLRTNVLKCRKQRIERMLVSPDDVVRLAAESEIFLKETVKLKDLLTYDEKCLDTT

EKINKFWSERLYTSFDGKPLAYSEYFPQGCGWIREDKIAQPAHIFAECIKLRINALPTRSRLARGRPTK

DRSCRAGCLDVQKEPAIESLNHIAQVCPRTHGARIKRHDRLVQFLCLNLKKNPKRNILVEYNFRTAA

GIRKPDIIIIEDTCAIILDVQVVGDSSNLEHEYLEKSRKYSNDANFINAFQKLYPLVTNLSFHAVTLNN

RGLIAKSTVTALRRLGVPPRCIMILCVISLEKTLEIWRIFNQSTAAARK

AAA21258.1 reverse transcriptase, partial [*Drosophila ambigua*];

SEQ ID NO: 31

PLGSQGDPLSPIIINMIIDRLLRVLPNEIGATVGNAITNAERFADDLVLFAETPMGLQKLLDTTVDFLS

SVGLTLNSDKCFTIGIKGQPKQKCTVVIPQSFCIGSRPCPALKRSDEWKYLGIHFTAEGRTRYSPAED

LGPKLLRLTRSPLKPQQKLFALRTVLIPQLYHKLTLGSVMIGVLRKCDIVVRSFIRKWLGLPMDVST

AFFHAPHTCGGLGVPSVRYLAPMLRMKRLSGIKWPHLVQSEAASSFLEVELNKARGRTLAGENELT

SRTAIETYWADKLYMSVDGSGLREARLFRPQHGWVFQPTRLLTGKDYRNGIKLRINALPSRSRTTR

GRHDLARQCRAGCDAPETNNHILQNCYRTHGKRVARHNCVVNNLKRILEEKGHTVHVEPNLQGES

AVSKPDLVAIRQNHAFVIDAQIVTDGLSLDQAHLPKVERYKRPDVITAVRRDFNVSGAVEVLSATLN

WRGIWSNQSVKGLITNNLLTTSDSNVISARVVIGGLYCFRQFMYLAGYSRNWT

KRX12851.1 Retrovirus-related Pol polyprotein from type-2 retrotransposable
element R2DM [*Trichinella nelsoni*];

SEQ ID NO: 32

MAAIRVNYPGPFTCQKCTFTETVFARFVTHCTHHALNVNLACSICGKDFTSINAVASHFPHCKKGTK

RNETPIDAPTNTEMHVSTHNTHICTVCSRAFNSFAGLRLHEKRAHPATFAASSQKPTKHQWTIDHLR

EAKEVEDQLTDSNSCSAKSFAEALSSKWSEAISVDMAKYLRKKLRRVDINFNAHNRGTTDGDTSGL

LPEVVGKSISLEGVGGKNRAALIGEEIHGVGVLSMRKTSGFRVEIVGQTTPSPNKSSNALSPQHRDRD

PGRDLRHHLEDSLTSCNSELEGLLNFLTNKILNSKPEDRNKYVDDVISIVTEFVCKPNGHQPPPAPKK

RTKEEPKNRRQKIRSKYAKMQSLFKRDPKRIAAHLIKNQPLCNVSCPIDAAESALRQRLSQRPSVDA

APFTSKCPPNSKNILDPISPEEVTLHLQRMKIHTSAGPDGIQVSHLRSCDPVCLAKAFNLFLLARHIPQ

QLKDCRTTLIPKIDHPRPDAEDYRPITVASSLYRLFSKIVTRRLEDSLSLHPRQKAFRSGTDGAFDNTS

TLMTIIRNAHKRGRELNIVSIDLAKAFDTINHTSIDRALRMQGLDVDSRALIAQMVTGSSTIIKGDGG

AFSNRIEINQGVRQGDPISPLLFNSVMDELIERLEKSKVGFKFMGEEITTLAFADDVTLISRSHRGMA

KLLSITLDFLNERGLSLNVNKCKGIRLVRTPKTKSLVQDTSKAFRVPNIGEEKQYIPMVPSGNVIKFL

GIQITLNGKPHFELAPLEGTLERIRKAPLKPAQKLATVRDYLIPSLEYKLGVPGISMKLLESVDAAIRL

TVKRFLHLQITGMNSMFLTMPIKEGGLGLRPLTTQRIARVAVGTNSMMTSMDNVSRVVANTATLR

KPLLSALEHFAVPAATKGAIREGKQNLLREEIAQLSETYQGSCLPSFKKGSLVNSWLRGTCGMRSRD

YITGLKLRFGVIETRSQKWRGRTPQNPDALLCRHCGHLSGYRETAAHISQKCPTTHATIIQRHNKIVN

LVADRAKREGFAVHVEPAIKSGGNVFKPDLVLVKDGAAHIVDVAVPWEKGTSMHEKHQKKTNEY

SPTVEEVRAQFDAETCTVGAIIIGARSSWCPSNNRSLKACGLHLPKKFKRLLCRVALEGTCKIFQNFF

TLT

KFD59471.1 hypothetical protein M514_11684 [*Trichuris suis*];

SEQ ID NO: 33

MVKSLPGKGLELLFNLWLYLGDVPSRLKECRTVLVPKRYPPQGPGDYRPITIASTLYRVFTKILANR

LSQCVELNRRQNGFMKGINGCGENTFILSTALESSRRHARELNLASLDLQKAFDTVSHASIRRALCR

QNVPTKGIQLLMNLLSNSYTRLDHANGMSAPIPMCRGVKQGDPLSPLLFNLVMDELLDELEGAGGG

FTFSPSTQVNCLAYADDILLLSDSRAGLQSNLLRCSRFLSARSLRLNIQKCSTLRMYKVPRIRSICATR

DPMFYLDPTDESTLLPAFTGAEFLHYLGVDFNPYGRRRDQVAGALVLLARVRRAPLKPQQKIELIRN

HLLPRLLYSLTVGNPLANTGRTIDKKIRQCVKEILHLPASTMCDDFFYVPRSRGGLGFLNLQEATDLS

VLRLMVKMRTNDDDVARTSAEQWFNQRRFAKLAARRGLPTANLGALHKVKEEIAKKHQERFQRS

YQGSGHAEFHDKRSNAWMGGEQMTGRGYINAIKVRASLVPTRVQTLRGRADPGDHRTLCRRCGD

VSRAPESLAHISQTCAFCHGLIIRRHNAIVQKLAQLAQTQGFQCTTEPIIRINDQTHKPDLVLAKNSSC

WTIDVSIPWESRDPLDRRHMQKCQKYRCLAEPVKKLTNSTEFSTGAIVIGARGAWCERNDDTLSRA

GLSITDRMKQLLCLITLEKTCQLISWFMRSTDRLALRQPTRHRSSAQRTEARIPRSVDQAAFGSPARH

HVAASPRHAPENRTVPAAH

KXZ75771.1 hypothetical protein TcasGA2_TC031700 [*Tribolium castaneum*];

SEQ ID NO: 34

MENFIIANNMCIFNEPNNPPTFETTNGASYIDLTIGSEFLLNKIQTWKTVDINTSDHRAITFEFNDNHN

QIFPEVNASMDQKICNFNIKKAAPLLEQLSTDLINKYSILISQNKIDQCLEKFYFELNKIISSCSRVKKT

FKNRPTFWNEQIEALRRQYLKAKKDLYKNKNPDLKEALYISMSQVKQKFKDRIKLDKEKSWENFV

KEDLAPNPWGVVYRVAAEKFKKTNLLGVFENDGETSLNPSDAAKRLLHSLLPDDNEENETLSQKIT

RQDFNTIEMTYRYNIDEVTNTELEIIIKNLKKKAPGLDKIDGNLTKIMHPSLSNFLLHIYNSCLRASYF

PKCWKMGNLVVIPKDSGGDPSDIKNYRPITLLNDLGKIFEKLIRTRLFKSTDVFHADNQYGFCVGKS

STDALLFFKNQLQAYNQKYKYTAAVFFDISGAFDNVWYPSIIKSLRQKGVSPHLIRIMKSYVSDRNV

```
IYSYRGIVNRKNCTKGCPQGSVLGPTLWNTILDEFLRKKIAPNTETIAYADDIVVITGANTRNEFRSTI

QTIVTAVCQFAGNQKLQVSSSKTKIMMFNSPKRVHNRDLAIKINNSTIQIVTEHKYLGILFDSKFNFQ

KHINNVCSKARTIMMALRRKIKLRWNISVADSISAIYNHAIIPIVTYGSEVWADRLNISKIKSKLTSLS

GLASRCIAGCYASVSNDAAHVLAGVPPLDLEAARINCCKLLKKDQNCNLLGFEIEKSDFDTYKHAR

EYVAILVEDLWQERWDSSTKGRTTYRFRPIVQSGLRYSHSFAATQILTGHGNFMSHLQRVGKSETD

ECAECGVRDDPIHRLLVCPLFDVPRRDIYRSVNSPFLSLNWIIHLKSELLEPFTALPQSLFIARTSRIAP

LRSDYIEHRESESGSENCFVLVQTVFQGKSRIEQHLDLDADQLISEIQKQQDLPESLPKNFVKTAFKV

GNKDGKANQWVVELHPVARNHFIKSGSRLFINWKSLHIRDYLRVTRCFKCQKFGHVSKFCNSEKQC

GYCASTDHESVTCKLKNEENKHKCIAAVFGSSPRTLTIPGEGHVEASRRFVPISAAGLQGEEPLVDRI

MIGSEDRGVSGLARKRVAADVPGLCEVKRCSVSAVNVESEFGPVPRPPAEPSCCEAPGAPVRARAM

GLTTLSGTKTSNSGAQGPSTSAPMQNMAGGFVCDCGRSYALKTSLARHKKECGKNNTECRWCGTR

FNTLAGTRQHERKAHFVQYQSDLAKALPQPESELMEKIAIVEARSSNGIFYKEMMASTGLTHQQVR

SRREKPEYKGFLERARRSLAQTNIRAGSISPASTIAGSLESASPKAGCSSSASPGPTTRSRAPTKGVPL

RSSNSARIVVEAQVHTRAPPNTGETEVALRESRRTVPRLGPNPSRPCGISPLMAIAIDEDSVLGGLRV

QAEPSPTAVHSVETFPGTSSMTPMETDRVHNKSGIDPILEHNGTRQVRREESSTREDPVEQWSPNYP

KTPVTMPNITTTADASCTSYNRTPQTLPGNRRRRSRSLPPVQRKSASDDLESVDSLGPWAVFLQDQV

DAGSLSGNDSLADLVRVALTKSDRGVLNDAVNRYLAQRAESLRIRKRGSKGKRKSKTGRHYGQTT

SGSGQRAALFKKHQDLFLKNRRGLAETILSGKEDFGPRPEPPVTSVEEFYGGIFESPSPPDNEPLEVRA

TGVEDPPTYITMDEIKAARAGWQISAPGSDQIPVAAVKTMSELELAILFNIILFRNVQPSAWGVLRTT

LVPKDGDLRNPANWRPITISSAMQRLLHRVLAARLSKLVSLSSSQRGFTEIDGTLANALILHEYLQYR

RQTGRTYQVVSLDVRKAFDTVSHCSVSRALGRFGIPSVIREYILATFGAQTTIKCGTVTTRPIRMLRG

VRQGDPLSPVLFNLVMDELLEKVNEKYEGGSLQSGERCAIMAFADDLILIADRDQDVPAMLDDVST

FLERRGMSVNPAKCRALIAGAVSGRSVVRTGSSYKIHNTPIPNVDALDAFKYLGLEFGHKGVERPTI

HNLSVWLNNLRRAPLKPDQKCLFIRQYVIPRLLYGMQNPQVTSKVLREADRLIRRHLKTYYHLNVH

TPDSLIHASVRDGGLGIMELRKAIPRIFLGRLVKLLNKNNDSVLSSVLQSDRVRTLMGKLSTMAGEV

PESTFWRNRIASGPLSKGLEQAAEDSASRLWISEKPSGWSGRDHVRAVQLRTGNLPTKAIPSVPVGQ

RRCRHGCACDESISHVLQMCPLTHADRIRRHDEVVKKVARHCTSRGWTVEVEPHIRSRCGRLFKPD

LAVHQPGGAIVIADVQISWDSESLTVPYERKRAKYDVPQFHQAAQHAWPGKALTFAPVIVGARGIW

PRINNDRSAALQIPPVVRRACVNSVVKWGSSIHATFMSETTAKGTGLEKLAGKEDPVELDSSLAL

XP_002412745.1 reverse transcriptase, putative [Ixodes scapularis];      SEQ ID NO: 35

MACSPHQFHPQKEPAALPSDFRPITVGPVLQRLFHKILAKRVMAAAPLDFRQRAFQPVDGCAENILL

LSTVLDEARCRLRPLHLASVDLAKAFDRVTTEAILRGALRAGFDDAFLAYLRELYATSYTTLQYGG

EELVVQPTTGVRQGDPLSPVLFNMVLDEFLSSVDPRVAFRSGDFTVDAMAFADDLVVCASTPQGLQ

QRLNDLAAFLSPRGLNINVAKSFTLSLQPSAREKKCKIVTTNRFHINGEPLPVSGVASVWRYLGVSFT

PDGTRSNGVEMELEEELLERVKKAPLKPQQRLLVLRTYLLPRLFHRLILGPWSVGLLKKLDTKVRAA

LRSWLALPHDVPLGYFHAPVGEGGLGVVSLRASIPSMRLRRIEGLRFSDHPGCAEALRCPLLLEGFPF

RNKN

BAE46603.1 reverse transcriptase, partial [Eptatretus burgeri];          SEQ ID NO: 36

ALAFADDLVLCARTSSGLRRSMDAVQTRLSAAGLVLNVEKSATLAITIDAKAKRYVVDTSEVFYLG

QQNLGVLDAASQLKYLGIQFLPRGAAPSDGSALEKGLRNLRRAPIKPQQRMFMLRDHLIPQLQHGL
```

VLGAARRGTLRKLDVQMRHHTRLWLRLPKDTPVAYFHARSADGGLGLPQFSVTIPILRERRMRGLE

QSDSPYVRAVIRTKLGDVVRSRNTYNLHYGGERPRSIKQADVITAKLLHQAVDGRGLLEASRVPEP

NDWVLGRSRLQSGRAFIDSVKVRGNLLPTGSRSSRGRRGQGSEGWCDAGCRAKESLNHISQACIRT

HGGTVQRHDAVSRFACGRLRQRGFVVIEEPRIPTPAGIRKPDHAEKNGKPVILDTQIKSDTLKLSDEH

VRKRNYYDTPEVLDWVRNKFESENVPLVSTITLSWRGVWAPESATLLRELGLTKTDLRLISVMVVE

KTALMFRWFKRSALTRNAPRQ

AFO20000.1 R2 protein, partial [*Triops cancriformis*];

SEQ ID NO: 37

PIIFNLVINGAIRRLPDEFGFEVSPKIFLNCLAYADDLILVATTRIGLKRLIIIVGEYLQRRGLKLSAEKSI

GLSITACGKEGLTYVSSANKIDFQGVEIKNMCVLDTWQYLGIQFSHIGCTDRITPEVSDLLFKLQKAP

LKVQQKLYALRHYLIPRLLHGLILSRVLITELKSIDNLIRKYVRSLLHLPKDTPLGYLYASTKDGGLGI

PCLRYLILKCRLARILRMRSSNDAVVREIANSEFLLHETQRLRDSLSIDGSVLDTNELIRKYWAKRLY

TSYDGKSLAYSEFFPYGNSWVREDHMNQRAHVFCDCIKLRINALPTRARTSRGRTESKDSSCRAGC

KFSSGIPMRETVNHITGVCQRTHDARVRRHDSIVDFLVSIWKTKSTNEVYKEPNYRTPLGLRKPDIV

VKTPNEVWIADVQVLADNANLEKEYSIKTNKYASDAGLIQGLKKQFPNINLFSFFAVTINNRGLISRS

SVNELRKRGVNSRDMLTIILRAMEGSLMIWRIFNQTTSSAR

KRX36111.1 Retrovirus-related Pol polyprotein from type-2 retrotransposable
element R2DM [*Trichinella murrelli*];

SEQ ID NO: 38

MGKRSTDNVNKLEGPLSNNEAPVNNRMVTRSTIKRATVVDSRSAPPLLVRPPVESPEFKLVCATIDN

RRQKSTASSAPLNNGGICQPLSEAPDDNAAVVSNSCAVSEIKEMPPARINMRLRSRKACGNIPEPPRL

PRTSQTASESHDGSQPCPGSSTAITSFPRASDNHPVSTNTQGTHVCSVCSRVFNSFPGLRLHEKRAHP

ATFAASSQKSVKHLWTTDHLREVKEVEEILAANNSRSVKALAEALSRKWSEDISMDMAKYLRKKL

RAVDLNSAQPTNTALTDGVNSPREGPENLTEEGESLNNGSQVIGTEIMGPERFPECDSFQTHSANAD

LSNPCPQHPDGLLSEQGLDRDQGGVLRKHLEDGLASCNSELEGLLNFIVSKVLNSGIEDRNKHVDA

AISVLTEFLCESKSHQPPPPRKKRTREEPKNRRQKIRSKYAQMQTLFKRDPKRVAAHLIRNQPLCNVS

CPIDAAESALRQRLSQRPGVDAAPITSKCPQNSKNILDPIFPEEVTLHLQKMKIHTSAGPDGIKVSHLR

SCDPVCLAKAFNLFLLARHIPQQLKDCRTTLIPKTDDPRPDAEDYRPITVASCLYRLFSKIVTRRLEDS

LSLHPRQKAFRSGTDGAFDNTSTLMTVIREAHNCGKELNIVSIDLAKAFDTVNHTSITRALRMHGLD

DESRTLITEMVTGSSTIIKGDGGALSNRIEINQGVRQGDPISPLLFNAVMDELVERLERTGEGFKLKG

VEVTTLAFADDVTLISRSHRGMEKLLSITLDFLNERGLQLNINKCKGIRLVRTPKTKSLVEDTSKPFR

VPSFGEENQHIPMVLPGDLIKFLGIDITLNGKPHFDLAPLEDTLERIRKAPLKPAQKLATVRDYLIPSL

EYRLGVPGISRKLLESVDGAIRLTVKRFLHLPLTGMNSMFLSMPVKEGGLGLRSLSTQHIARLAVGT

NSMSISTDTVSRVVADTTTLRKPLLSALEHFAVPTATKSAIREGKRNLLRAEIAQLSETYQGSCLPSF

KHGSLVNTWLRGTSGMRSRDYITGLKLRFGVIETRSQKWRGRTPQNPDALLCRHCGHSSGNRETAA

HVSQKCLVTHALIVQRHNKIVRLVGDRAKDEGFAVHVETAVKSGEEVYKPDLILIKADTAHIIDVAV

PWEKGTNMHEKHERKTNKYAQLVDDVKALFGVQNCTVGALVIGARSSWCTSNDGSLKACGLHLP

KKTDGEDLTTEADDSDAEPWQKPEHSPPHAKENTEDRNTEEQSEPYTTPQTLRTSENPEIQRRRRLH

RTTTRRDCARRTDHNWTPERGTTHPQKGP

KRZ66264.1 Retrovirus-related Pol polyprotein from type-2 retrotransposable
element R2DM [*Trichinella papuae*];

SEQ ID NO: 39

MGKPSRPAQETPSTAAGSDGQARSGLRRRNHAEVTYPGPFTCTVCSLTECVYSRFKNHCMTHHLHL

ELSCSVCRKVFPTINAVACHYPHCAKTPRNPNISQNIPETTQVGRTVASSINNKGISENKEPPQNNRV

VTRSQVKRAAVGAVTRSRSSLCNGAPAVNAAAGIVRSQVNVVFPDCATLNNNSRQRLMVAPAPPN

-continued

```
NGELCSPLSGKVTDGGNVIVRRSARLASNCEAGLHNNGADASSVANVPVIKEVPPARTYRRNRPAS

ANTNITETPRQPPPTSMTVPECRRRTREQPQRTTASEATQPAAPTVADNAFPCGECGRVFSTFAGMRL

HLKRAHPSSFSSLQPPVKVPRWSALESDTLRELEDALRRNGELSNEKLASLMTDRFERVFTIDMVKG

HRRKFRETPRTEGENSRPSTPRESTPAPTAQTSPSTMPVNNITRDNPETAEDINKKLKQHLLHCTTTH

NTEVEAEINDIIRNHIIKGNNKNYVTRIVKYLIGAMRPEEERGPKKGRKKKKPEPSVPLNSKQRKRM

AYRKVQQAYHKDPKRVVAHLFHSQPLENVSCPVESGEKALQARLGKRPPADRAPFLPKRAPLKNH

LLSPISAKEVSEHLKQMNLASASGPDGVKVSHLRDIGPQCLSKIFNTFLLERHIPQVLKDCRTTLIPKV

DNPRPDAEDFRPITIGSCIYRLFSKIVTSRLSQLTPLNPRQKAFRSGTDGAFDNITTVASLLKLARKTG

KEINLACIDLAKAFDTVNHTSITRALHRHGVDSASIELVESMVGEATTVIINSDGTRSNVIKFNRGVR

QGDPISPLLFNLVLDELIDNLDQARCGFSITKEIQVSCVAFADDITLVSGSREGMNNLLTITREFLGER

GLGINHSKCKGIRFTKVPKSKSLIIDTNPNCFLIRNQQGTPEPIPMAKPGEPLKTLGINLTLEGNPTFNY

PELTRILNTIKHAPLKPHQKVQIIRDHLIPLLQYKLGVPTFYRATLNNIDKSIRLTVKEILHLPTTGLHN

SYLYLPLKEGGLGLKRLATQYASRVGLGLSNMATSDDAVSRAVAGLHLSLMDKAKNCLGLSEISK

EAIKKAKEKLVQAEIRTLLQCHLGRSHSSFTNDTISNSWMRYPTFLSARNYIMGIKLRAGIIEIRAQK

WRGRSPPHPTMLLCRHCGARSRTRETDIHVSQKCLHNKKLILRRHNCVVSTLGRRATQQGFAVYYE

PCIKHGETVLKPDLVIIKGDTATIIDVAVPWEQGTNLREHNSRKISKYQCLEREAAKYFNVKTVKTG

SLVVGARGKWSAGNDSTLKSCGLHCSKRLKKLLCTIALEGTCAVFKH
```

KRY45664.1 Retrovirus-related Pol polyprotein from type-2 retrotransposable
element R2DM [Trichinella britovi];

SEQ ID NO: 40

```
MVTRSTIKRATVVDSRSAPPLLDRPPVERPEIKLVCATIDNRRQKSTAASAPLNIVGICQPLFEAPDDN

AAVVSNNCAVSEIKEMPPARINMRLRSRKACGNILEPPRPPRTSQSASESHDGSQPCPGSSAASTNSP

RASISQPASTNAQGTHVCSVCSRAFNSFPGLRLHEKRAHPATFAASSQKSVKHLWTIDHLREVKEVE

EMLAANNSRSVKALAEALSRKWSEDISMDMAKYLRKKLRAVDLNSAQPTNTALTDGVNSPREGPE

NTTEEGESLNNGSQVVGTEIMGPERLPECDSLQTHSANADLSNPCPQHPDGLLSEQGLDRDQWGVL

RKHLEDGLASCNSELEGLLNFIINKILNSGSEDRNKLVDAAISVLIEFLGEPKSHQPPPPRKKRTREEP

KNRRQKIRSKYAQMQTLFKRDPKRVAAHLIKNQPLCNVSCPIDAAESALRQRLSQRPGVDAAPFTS

KCPQNSKNILDPIFPEEVTLHLQNMKLQTSAGPDGIKVSHLRSCDPVCLAKAFNLFLLARHIPQQLKD

CRTSLIPKTDDPRPDAEDYRPITVASCLYRLFSKIVTRRLEDSLSLHPRQKAFRSGTDGAFDNTSTLM

TVIREAHSCGKELNIVSIDLAKAFDTVNHTSITRALRMHGLDDESRTLITEMVTGSSTIIKGDGGALSN

RIEINQGVRQGDPISPLLFNAVMDELVERLEQTGEGFKLKGVEVTTLAFADDVTLISRSHRGMEKLL

STTLDFLNERGLKLNISKCKGIRLVRTPKTKSLVEDTSKPFRVPSFGEENQHIPMVLPGDLIKFLGIDIT

LNGKPHFDLAPLEATLERIRKAPLKPAQKLATVRDYLIPSLEYRLGVPGISRKLLESVDGAIRLTVKR

FLHLPLTGMNSMFLSMPVKEGGLGLRSLSTQHIARLAVGTNSMSISTDTVSRVVADTTTLRKPLLSA

LEHFAVPTATKSAIREGKRNLLRAEIAQLSETYQGSCLPSFKHGSLVNSWLRGTSGMRSRDYITGLK

LRFGVIETRSQKWRGRTPQNPDALLCRHCGHSSGNRETAAHVSQKCLVTHALIVQRHNKIMRLVGD

RAKDEGFAVHVETAIKSGEEVYKPDLILIKDDTAHILDVAVPWEKGTNMHEKHERKTNKYAQLVG

DVKALFGVQNCTVGALVIGARSSWCPSNDGSLKACGLHLPKKPDGEDLKTEDNHPCAESRQRPKH

SPPLEEENTEERNTAEQTEPCTTPQTLRTTENPDIRRRTRLNRTTTRRDCARRTGHNWTPYIKTDLCR

NIGLNLSLIKSHWCASQIRLTAAGTFLRESPANSATSQMPRHLISDAYEWINKIPSVPIYYLAKPQPRE

RAWQNQRGKKTLLSLTLV
```

CAJ00246.1 TPA: polyprotein [*Schistosoma mansoni*];

SEQ ID NO: 41

MPVSTGAETDITSSLPIPASSIVSPNYTLPDSSSTCLICFAIFPTHNILLSHATAIHHISCPPTPVQDGS

QQMSCVLCAAAFSSNRGLTQHIRHRHISEYNELIRQRIAVQPTSRIWSPFDDASLLSIANHEAHRFPTK

NDLCQHISTILTRRTAEAVKRRLLHLQWSRSPTAITTSSNNHTITDIPNTEARYIFPVDLDEHPPLSDAT

TPNASTHPLPELLVILTPLPSPTRLQNISESQTSHESNKNSMHTPPTYACDPDETLGATPSSTIPSCFHS

YQDPLAEQRGKLLRASASLLQSSCTRIRSSSLLAFLQNESTLMDEEHVSTFLNSHAEFVFPRTWTPSR

PKHPSHAPANVSRKKRRKIEYAHIQRLFHHRPKDASNTVLDGRWRNPYVANHSMIPDFDCFWTTVF

TKTNSPDSREITPIIPMTPSLIDPILPSDVTWALKEMHGTAGGIDRLTSYDLMRFGKNGLAGYLNMLL

ALAYLPTNLSTARVTFVPKSSSPVSPEDFRPISVAPVATRCLHKILAKRWMPLFPQERLQFAFLNRDG

CFEAVNLLHSVIRHVHTRHTGASFALLDISRAFDTVSHDSIIRAAKRYGAPELLCRYLNNYYRRSTSC

VNRTELHPTCGVKQGDPLSPLLFIMVLDEVLEGLDPMTHLTVDGESLNYIAYADDLVVFAPNAELL

QRKLDRISILLHEAGWSVNPEKSRTLDLISGGHSKITALSQTEFTIAGMRIPPLSAADTFDYLGIKFNF

KGRCPVAHIDLLNNYLTEISCAPLKPQQRMKILKDNLLPRLLYPLTLGIVHLKTLKSMDRNIHTAIRK

WLRLPSDTPLAYFHSPVAAGGLGILHLSSSVPFHRRKRLETLLSSPNRLLHKLPTSPTLASYSHLSQLP

VRIGHETVTSREEASNSWVRRLHSSCDGKGLLLAPLSTESHAWLRYPQSIFPSVYINAVKLRGGLLST

KVRRSRGGRVTNGLNCRGGCAHHETIHHILQHCALTHDIRCKRHNELCNLVAKKLRRQKIHFLQEP

CIPLEKTYCKPDFIIIRDSIAYVLDVTVSDDGNTHASRLLKISKYGNERTVASIKRFLTSSGYIITSVRQT

PVVLTFRGILDRASSQSLRRLCFSSRDLGDLCLSAIQGSIKIYNTYMRGT

Q03278 Retrovirus-related Pol polyprotein from type-1retrotransposable element R2 [*Nasonia vitripennis* (Parasitic wasp)];

SEQ ID NO: 42

NQIKKSNTSTGARIPKAMTNPADNFAGGQWKPPGRRSARTSATGMFVCEHCLRAFTTNTGRGLHIK

RAHEEQANEAITTERSRARWTNEEMEAVQAEIDCEGRTAINQEILRIIPYQRTIDAIKCLRKQQKYKTI

RERVANRRAENRARETELTRLETADEDPASQEQDNPNMSLKNWLKEVIESDDDRLCADLRTAIEMA

LAGQSPLDVCTVGCYQYTMTNLPLVPVRLGGPIYWCNAQSRSNPGETQRRQTIKESNNSWKKNMS

KAAHIVLDGDTDACPAGLEGTEASGAIMRAGCPTTRHLRSRMQGEIKNLWRPISNDEIKEVEACKRT

AAGPDGMTTTAWNSIDECIKSLFNMIMYHGQCPRRYLDSRTVLIPKEPGTMDPACFRPLSIASVALR

HFHRILANRIGEHGLLDTRQRAFIVADGVAENTSLLSAMIKEARMKIKGLYIAILDVKKAFDSVEHRS

ILDALRRKKLPLEMRNYIMWVYRNSKTRLEVVKTKGRWIRPARGVRQGDPLSPLLFNCVMDAVLR

RLPENTGFLMGAEKIGALVFADDLVLLAETREGLQASLSRIEAGLQEQGLEMMPRKCHTLALVPSG

KEKKIKVETHKPFTVGNQEITQLGHADQWKYLGVVYNSYGPIQVKINIAGDLQRVTAAPLKPQQRM

AILGMFLIPRFIHKLVLGRTSNADVRKGDKIIRKTVRGWLRLPHDTPIGYFHAPIKEGGLGIPAFESRIP

ELLKSRIEALGASNMQTARSLLGGDWVAERKKWINTQKIKNSEWAQKLHLTTDGKDLRDTRKAEA

SYSWIRDIHVAIPASVWIKYHHTRINALPTLMRMSRGRRTNGNALCRAGCGLPETLYHVVQQCPRT

HGGRVLRHDKIAEQVAIFMQEKGWLVLREAHIRTSVGLRKPDIIARKGQDCKIIDCQIVTTGNDIRIQ

HERKIQYYASNWELRRSAATMIGHQGQVSVEAITISWKGVWEPRSYCLLRDCGIPKVKIKGLTTRVL

LGAYLNFNTFSKATYRTERRRTAN

Q03279 Retrovirus-related Pol polyprotein from type-1 retrotransposable element R2 [*Bradysia coprophila* (Dark-winged fungus gnat) (*Sciara coprophila*)];

SEQ ID NO: 43

VSVPPTSYRDRIMNALEESMIDVDAIRGSSARELVEIGKVALLNQPMDEGRIMSWLSDRFPDTQKPK

GPIYSKTTIYHGTNKQKRKQRYALVQSLYKKDISAAARVVLDENDKIATKIPPVRHMFDYWKDVFA

TGGGSAATNINRAPPAPHMETLWDPVSLIEIKSARASNEKGAGPDGVTPRSWNALDDRYKRLLYNIF

-continued

VFYGRVPSPIKGSRTVFTPKIEGGPDPGVFRPLSICSVILREFNKILARRFVSCYTYDERQTAYLPIDGV

CINVSMLTAIIAEAKRLRKELHIAILDLVKAFNSVYHSALIDAITEAGCPPGVVDYIADMYNNVITEM

QFEGKCELASILAGVYQGDPLSGPLFTLAYEKALRALNNEGRFDIADVRVNASAYSDDGLLLAMTV

IGLQHNLDKFGETLAKIGLRINSRKSKTVSLVPSGREKKMKIVSNRRLLLKASELKPLTISDLWKYLG

VVYTTSGPEVAKVSMDDDLSKLTKGPLKPQQRIHLLKTFVIPKHLNRLVLSRTTATGLCKMDLLIRK

YVRRWLRLPGDVPVAFLYAPVKAGGKGIPCLKQWIPLMRFLRLNKAKRTGGDRIAAVLNCQLYASI

SHSCKTGPVSVGLWRSTNTGGLSAYWRRILIGMVDGKDLKSAQNHSSATSFNSIRMNDISGEDYIHY

NQLRTNSIPTRKRTARGRPNKPTACRAGCDKLKRLQHDIQGCIRSQGGLVQRHDRVVDLLFDECET

KGYAAEKVVHLRTSEELWKPDLVLKKNGRVVVVDAQVVQCGRLESDHRVKVSKYRDDPELADVI

REKYAVQEVTFEACTLSYKGIWSKNSVEGLQKLGISNYCLFKIVTSVLRGSWLNWVRFNNVTTVVHW

KXZ75830.1 hypothetical protein TcasGA2_TC031908 [*Tribolium castaneum*];
SEQ ID NO: 44
MVPLLLVLDLEPTVLTTPLDLRERTMLMDMDSEDEAGEHGPPADNAHLTSGEPIEIILMLPFQSRSCI

CLNAGKGNFRATADGDLESWCGSDVHHLRKTSWRKPQTGMKSRSFRRIGDCAAGSSRRGVRLTGK

AGREGRFAASPHLSPRYLAGSVSGNVPSVPPNPGLGAGAPAFAAVPNADGGPAQNPCPYCARSFTT

ANGRGLHIRRAHPDEANNAIDIERIHARWSHEETAMMARLEAGAIQRGGVRFMNQFLVPRMPGRTL

EAVKSKRRDATDKALVQRFLQGDRLCNIARRACDGGDVSGQLLGWLRDVFPVKRVSTRGDQSNL

DVDGALVSRHTARTREYARVQELYRKDPKACLARIFGDRREGANRAPNRDPAFIDFWRGVFSEASA

EVEGCAEEVSDHGGGKVSGPEWCSAGARRNSGFRVEQLPPEAAALLFNVLLLGRCLPAELTRTRTV

FIPKTDAPRTPADYRPISIASVVARHFHRVLSAHVQRIPDLFTKYQRGFLSGVDGIADNLSVFDTMLT

MSRRCCKHLHLAALDVSKAFDTVSHFAIVRACRETHSLLSSLTWSWTGLLKRLSTDVGFRLTDATK

VTALAFADDVVLCATTARGLQTNLDVLEAELRLAGLLLNPNKCQALSLVASGRDHKVKLVTKPTF

TVGQNTILKGSGMCGCGSEGVAAGLKRNTCAPLKPQQRMHLLRVFFLPKFYHAWTFGRLNAGVLR

RLNVVVRTSVRTWLRLPHDIPVGKFHAPTKSGGLGIPQLSRLIPFLRLKRFDRLGRSAVDYVRECAFT

DIADQKIRWCRERLSGIVDQVAGGRDALDAYWTAQLHQSVDGRALRESASVASSTQWLRCSTRAIP

ASDWLHYTAVHIGALPSRVRTSRGRRGGQDVSCRGGCLLDETPAHCIQVCHRTHGGRMLRHDAIA

KRISADLMELGWIVTREVSFRTTAGVFRPDMVAVKEGVTVILDVQIVSPAPTLDEAHRRKVAKYRD

RADLARYLAEAAVARGRAPPANIRFASATISWRNVWSAESVGSLRELRLSARHFNRYTTMSFCGSW

RNWVRFNASTASGMGRGRGDASPRRHENQHDNDSLADLVRVALTKSDRGVLNDAVNRYLAQRA

ESLRIRKRGSKGKRKSKTGRRYGQTTSGSGQRAALFKKHQDLFLKNRRGLAETILSGKEDFGPRPEP

PVTSVEESYGGIFESPSSPDNKPFEVRATGVEDPPTYITMDEIKAARAGWQISAPGSDQIPVAAVKTM

SELELAILFNIILFRNVQPSAWPSQGAVRPCRWWEGLSTCNESAGNAGGSHGRDSWQGHPCQ

P16423.1 Retrovirus-related Pol polyprotein from type-2 retrotransposable
element R2DM [*Drosophila melanogaster*];
SEQ ID NO: 45
FERKNFSDGLVPQRKFIHIGTTSTNNEPRIPLHNLMTTRPSVDIFPEDQYEPNAAATLSRVPCTVCGRS

FNSKRGLGVHMRSRHPDELDEERRRVDIKARWSDEEKWMMARKEVELTANGCKHINKQLAVYFA

NRSVEAIKKLRQRGDYKEKIEQIRGQSALAPEVANLTIRRRPSRSEQDHQVTTSETTPITPFEQSNREI

LRTLRGYSPVECHSKWRAQELQTIIDRAHLEGKETTLQCLSLYLLGIFPAQGVRHTLTRPPRRPRNRR

ESRRQQYAVVQRNWDKHKGRCIKSLLNGTDESVMPSQEIMVPYWREVMTQPSPSSCSGEVIQMDH

SLERVWSAITEQDLRASRVSLSSSPGPDGITPKSAREVPSGIMLRIMNLILWCGNLPHSIRLARTVFIPK

TVTAKRPQDFRPISVPSVLVRQLNAILATRLNSSINWDPRQRGFLPTDGCADNATIVDLVLRHSHKHF

RSCYIANLDVSKAFDSLSHASIYDTLRAYGAPKGFVDYVQNTYEGGGTSLNGDGWSSEEFVPARGV

```
KQGDPLSPILFNLVMDRLLRTLPSEIGAKVGNAITNAAAFADDLVLFAETRMGLQVLLDKTLDFLSI

VGLKLNADKCFTVGIKGQPKQKCTVLEAQSFYVGSSEIPSLKRTDEWKYLGINFTATGRVRCNPAE

DIGPKLQRLTKAPLKPQQRLFALRTVLIPQLYHKLALGSVAIGVLRKTDKLIRYYVRRWLNLPLDVPI

AFVHAPPKSGGLGIPSLRWVAPMLRLRRLSNIKWPHLTQNEVASSFLEAEKQRARDRLLAEQNELLS

RPAIEKYWANKLYLSVDGSGLREGGHYGPQHGWVSQPTRLLTGKEYMDGIRLRINALPTKSRTTRG

RHELERQCRAGCDAPETTNHIMQKCYRSHGRRVARHNCVVNRIKRGLEERGCVVIVEPSLQCESGL

NKPDLVALRQNHIDVIDTQIVTDGHSMDDAHQRKINRYDRPDIRTELRRRFEAAGDIEFHSATLNWR

GIWSGQSVKRLIAKGLLSKYDSHIISVQVMRGSLGCFKQFMYLSGFSRDWT
```

KRX34481.1 Retrovirus-related Pol polyprotein from type-2 retrotransposable
element R2DM [*Trichinella murrelli*];

SEQ ID NO: 46

```
MSNRLANTAAAGGVPEKNSGTLDIPGQPSSSGEKRAISYPGPFGCNSCSFTSTTWLSMELHFKSVHN

TCEFVFLCSKCEKSWPSINSVASHYPRCKGSVKAAVVPSSLTNTCTTCGSSFGTFSGLQLHRKRAHP

DVFAASCSKKTKARWSNDEFTLLARLEAGLDPACKNINQVLAERLMGYNITRGVEMIKGQRRKDQ

YKALVRQLRSNSETQQCVGLAGSMDLNVPVNDTTSSVASEVTITYPEYGAVMSCDLIKEATGMAM

VDVNELQSNIRKLFSSGRKLPMKLRGAREAVQKKMANPRVAKFKRFQRLFRSNRRKLANHIFDKAS

LEQFGGSIDEASDHLERFLSRPRLESDSYSVISGDKSIGVAHPILAEEVELELKASRPTAVGPDGIGLE

DIKKLNSYDLASLFNLWLKAGDLPESVKASRTIFLPKSDGTTDISNCRPITIASALYRLFSKIITRRLAA

RLELNVRQKAFRPEMNGVFENSAILYALIKDAKVRSKEICITTLDLAKAFDTVPHSRILRALRKNNV

DPESVDLISKMLTGTTYAEIKGLQGKPITIRNGVRQGDPLSPLLFSLFIDEIIGRLQACGPAYDFHGEKI

CILAFADDLTLVADNAAGMKILLKAACDFLEESGMSLNAEKCRTLCISRSPRSRKTFVNPAAKFNIS

DWKTGVSSEIPSLCATDTFRFLGHTFDGEGKIHIDTEEIRSMLKSVKSAPLKPEQKVALIRSHLLPRLQ

FLFSTAEVDSRKAWLIDSIIRGCVKEILHSVKAGMCTDIFYIPSRDGGMGLTSLGEFSLFSRQKALAK

MAGSSDPLSKRVAEFFIERWNIARDPKVIEAARRVYQKKRYQRFFQTYQSGGWNEFSGNTIGNAWL

TNGRARGRNFIMAVKFRSNTAATRAENLRGRLGMKECRFCKSAIETLAHICQKCPANHGLVIQRHN

AVVTFLGEVARKEGYQVMIEPKVSTPVGALKPDLLLIKADTAFIVDVGIAWEGGRPLKLVNKMKCD

KYKIAIPAILETFHVGHAETYGVILGSRGCWLKSNDKALASIGLNITRKMKEHLSWLTFENTIRIYNSF

MKN
```

EEB15300.1 reverse transcriptase, putative [*Pediculus humanus corporis*];

SEQ ID NO: 47

```
MRTRQSKNQNKSCSTVDLRQLDENVNFTASDPGHSNDVSHRSPVQETTRSHRIRWTQEDLQELMW

CYFYSQKFGSGSESDTFKIWRGRNPNSRKDMTSKKLAAQRRYIIKKIENDKLEEIKKNVDSSCSNVIR

DNAPIITKLNESNNNNRYETDTDEQLLTDAEMKSIEERLIEEIKKVKMCPLINREPLRKIYKNKKATE

VLHLIDNTLINVLEKVVDINLTTINEIIYAAGVVATDIILGPRKEARHKGIETKKSTSPIWIQRIEGKIKR

IRSHISLVSEMKKNNNLKKRTIKKLDHLKRIYKLKTMEDIELTMETLKQKVLLYSQRIRRYKKREQF

WRQNKLFESDPKKFYRTIREQNIQNGSSTLNVEKMADFWSNIWEKSHPLNKNSTWMNKEKEAHA

WIASSTMSDIIMADLEICLKNTANWKSPGLDRVQNFWIKNFTSTHKYLLVSINKLIMGRQEMPEWIT

TGKTYLLPKKSGAMEPKDFRPITCLPTMYKIITAIIAEKIYGHLRKNNIFPPEQYGCRKGSYGCKEVLL

INKLIMASAKQKRKNLSMAWIDYQKAFDSVPHEWIIEALKIYKVDPKITAFCEKSMKNWCTQLEVQ

KYSSRKIFIKRGIFQGDSLSPLLFCMSLIPLSRQLNIKDQGYQLVPGGRKITHMLYMDDLKLYAKNEE

ELNKMLRTVQTFSSDINMKFGLEKCARINIVRGKLKQKQNIEDSEEELIKELDPGSSYKYLGIEENFGI

ANKEIKPRLKKEYFKRLRLILQSELNGRNKITAVGTLAVPVIEYSFGLVDWTKEEITHLDRRTRKILT

MNGALHPKADVDRLYVSRKDGGRGLRQIEAAHQNAIIGMGKYIESHREDPILAQVIHAEEKTTKKG
```

-continued

VLKRAKQIVQENKENEIMEEGQLATYNSKAQSQKKLIGKWEQKKLHGQYLKRINAEDINKKSTHN

WLRRGKLKIETEAFITAAQDQALRTHNYEKVILKVRQDDKCRICQSQSETIDHLISGCPILAKHEYLE

RHNKICQYLHWSICREYGMDGLPKEWYNHIPSPVTTVGPCTVLYDQQIHTDRTVPANKPDIILRHNG

EKWCKLIEVSVPAEKNTTAKEADKRLKYRNLEIEITRMWGTKTETIPVIVGALGAMPHSIKGNLKKI

MKNLKEETIQEIALCGTAHILRKIL

XP_002431867.1 reverse transcriptase, putative [Pediculus humanus corporis];
SEQ ID NO: 48

MRTRQSKNQNKSCSTVDLRQLDENVNFTASDPGHSNDVSHRSPVQETTRSHRIRWTQEDLQELMW

CYFYSQKFGSGSESDTFKIWRGRNPNSRKDMTSKKLAAQRRYIIKTQKIENDKLEEIKKNVDSSCSN

VIRDNAQIITELNESNHKSKTDTDEQLLTDAEMKSIEERLIEEIKKVKMCPLINREPLRKIYKNKKATE

VLHLIDNTLINVLEKVVDINLTTINEIIYAAGVVATDIILGPRKEARHKGMETKKSTSPIWIQRIEGKIE

RIRLHISLVSEMKKNNNLKKRTIKKLDHLKRIYKLKTMEDIELTMETLKQKVLLYSQRIRRYKKREQ

FWRQNKLFESDPKKFYRTIREQNIQNGFSTLNVEKMADFWSNIWEKSHPLNKNSTWMNKEKEAHA

WIASSTMSDVRMADLETCLKNTANWKSPGLDRVQNFWIKNFTSTHKYLMVSINKLIMGRQEMPEW

ITTGKTYLLPKKSGATEPKDFRPITCLPTMYKIITAIIAEKIYGHLRKNNIFPPEQYGCRKGSYGCKEVL

LINKLIMASAKQKRKNLSMAWIDYQKAFDSVPHEWIIEALKIYKVDPNITAFCEKSMKNWCTQLEV

QKYSSRKIFIKRGIFQGDSLSPLLFCMSLIPLSRQLNIKDQGYELVPGGRKITHMLYMDDLKIYAKNE

EELNKMLRTVQTFSSDINMKFGLEKCARINIVRGKLKQKQNIEDSEEELIKELDPGSSYKYLGIEENF

GIANKEIKPRLKKEYFKRLRLILQSELNGRNKITAVGTLAVPVIEYSFGLVDWTKEEITHLDRRTRKIL

TMNGALHPKADVDRLYVSRKDGGRGLRQIEAAYQNAIIGMGKYIESHREDPILAQVIHAEEKTTKK

GVLKRAKQIVQENKENEIMEEGQLATYNSKAQSQKKLIGKWEQKKLHGQYLKRINAEDINKKSTH

NWLRRGKLKIETEAFITAAQDQALRTHNYEKVILKVRQDDKCRICQSQSETIDHLISGCPILAKHEYL

ERHNKICQYLHWSICREYGMDGLPKEWYNHIPSPVTTVGPCTVLYDQQIHTDRTVPANKPDIILRHN

AEKWCKLIEVSVPAEKNTTAKEADKRLKYRNLEIEITRMWGTKTETIPVIVGALGAMPNSIKGNLKK

IMKNLKEETIQDIALCGTAHILRKIL

SEQUENCE LISTING (264 sequences)

SEQ ID NO: 1 - protein, 1114 aa, Bombyx mori
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 2 - protein, 1114 aa, Bombyx mori; identical to SEQ ID NO: 1

SEQ ID NO: 3 - protein, 1451 aa, Lasius niger
MSGPGGGTPQHAGPSALSSKLDEFRLRVCSEGSALHGQDAAQRRAKRLATSPPHDPIDLELDPPPLSDAGLRGIKDELSAHDITFASINATSKESVNRKKELEEVIAAYRRAVDDLMMAYIKIKTERDTTAKIWKMMRSTSRGDSGSDLGIEIAGAVQESTGAAIRGMLGEWHARESERTKALVTEMTASMSGQFEGCVRRAVETLASFREAPSVPQIAGRSYAGAVRASGAVAGPQLPSGRRELRDQSRLETIEVVPGENMSKNLPDSEATCRAVLTSIKPSEAGIKVDRVIKGRNKTVRIVADQDEISRLRPMLDNLGMEVKRVDKLNPRLRIRDIPVGTDKSLFVKDLIKQNLDGASEEDIRLVYWSPAKGRMGPAAVIEVSPDIRIRLLNQGRVYLGWSSCRVADHLRVLQCFKCLGFGHTANNCQAGSDTCGHCDNVHNSVDNLNVGRLDGFVCPICLRSFSSKIGLGLHKKKKHPVEYNEEIVVARVRPRWTDEEIRLLAIDEAGAPPQTRSMNSYLLERRGDDRSLESIKGVRRKQAYKDLVAEYRGQLLDQRIDESLSQPDARPIAAMVDGVPLSGSVAAKDWLLAKCDSIIPEMNGGIWIRTAIRRLEEGQSPEGALDDWWNNVFSDLEVTGRKRVARGPRAIPVLSKRKARRIEYRRMQQLWRTNMTKAAHKVLDGDAGSLPHPTLAAQLGFWKPVLEAESVDLAWPFAVGHPGVAVGDLWSPITEGEVINIRLPRTSSPGLDGLTVHRWFTEVPAILRATILNIFMATGWVPPRFRHSRTVLIPKSSDLMDPAYYRPISVSSVILRHFHKILARRVAACELLDVRQRAFIAADGCAENVAVLSAILFDARTNRRQLHVITLDVRKAFDTVSHNAIRYVLSKHGMPQIMVEYLSTLYRTAAVRLEVDGEFSDEILPGRGVRQGDPLSPLLFNLIMNEILAEVPDQVGYCMMDRNVNALAFADDLVLIGATRDGAQRSLERVMAALYRFGLELAPAKCAAFSLVPCGKTKRIKILTDPQFVAGDRPIPQLGVLHTVRYLGVRFGETGPVIQGVELLPLLERITRAPLKPQQRLKILRTYLIPRYTHNLVLGRVSYSMLRKLDKQTRAAVRRWLVLPDDVPVAFFHCPIKQGGLGIQSFETAIPRLTLLRLNRLKDSQYEMARVVGSSAWADRRMRWCRFARRRDEDWPSELHAKVDGFELREAGNVSVSTRWLDDAMVHIPSSDWLQYVKVWINALPTRIRTTRGSRRLREDVNCRGGCGVQETAAHVVQQCFRTHGGRIMRHDAVASALAGELQRGGYNVHRERVFRTREGVRKPDILAAKGTHGHVLDVQIISGARPLSDGHDRKRSYYANNADLLARISALLQVPVRNLDVSTVTLSWRGVWARESAAVLTSLGVSKAVLRGITTRVLKGSYMNFSRFNQTTATCRGRANLRMSGWGPP

SEQ ID NO: 4 - protein, 1484 aa, Tribolium castaneum
MSNPSSVPCLLASRGTVLLRGSGCARQGVRKSSSAAIQRALNVNVKKFKQARVNGGSNYDSLILLCYDFAAGRNADGEPAQNPCPYCARSFTTANGRGLHIRRAHPDEANNAIDIERIHARWSDEETAMMARLEAGAIQQGGVRFMNQFLVPRMPGRTLEAVKGKRRDATYKALVQRFLQAPQINLPELRDGDAPRQPDPQRENPPEPPAFDGAIRGAVADLVGGVDWQRLGFQGDRLCDIARRACDGEDVSGQLLGWLRDVFPVKRVSTRGDQSDLDVDGASVSRRTARRREYARVQELYRKDPKACLARILGDRREGANRAPNRDPAFIDFWRGVFSEASAEVEGWAEEVSDHGELARRVWDPISVEEVGRSRVRNGAAPGPDGIAVSVWNKLPPEAAALLFNVLLLGRCLPAELTRTRTVFIPKTDAPRTPADYRPISIASVVARHFHRVLSARVQRIPDLFTKYQRGFLSGVDGIADNLSVLDTMLTMSRRCCKHLHLAALDVSKAFDTVSHFAIVRACEQAGLPQPFVEYVRSIYGSAETVLEEGGRRHFVQVRRGVRQGDPLSPLLFNLVLDRALKRLSTDVGFRLTDATKVTALAFADDVVLCATTAKGLQTNLDVLEAELRLAGLLLNPNKCQALSLVASGRDHKVKLVTKPTFRVGQNTIHQVDASSIWKYLGIQFRGSGMCGCGSEGVAAGLKRITCAPLKPQQRMHLLRVFFLPKFYHAWTFGRLNAGVLRRLDVVVRTYVRTWLRFPHDIPVGYFHAPTKSGGLGIPQLSRFIPFLRLKRFDRLGRSAVDYVRECAFTDIADRKIRWCRERLSGIVDQVAGGRDALDAYWTAQLHQSVDGRALRESASVASSTQWLRCSTRAIPASDWLHYTAVHIGALPSRVRTSRGRRGGQDVSCRGGCLLDETPAHCIQVCHRTHGGRVLRHDAIAKRISVDLMELGWIVTREVSFRTTAGVFRPDMVAVKEGVTVILDVQIVSPAPTLDEAHRRKVAKYRDRADLARYLVEAAVARGRAPPANIRFASATISWRGVWSAESVGSLRELGLSARHFNRYTTMALCGSWRNWVRFNASTASRMGRGRGDASPRRHENQHDNDSLADLVRVALTKSDRGVLNDAVNRNLAQRAESLRIRKRGSKGKRKSKTGRHYGQTTSGSGQRAALFKKHQDLFLKNRRGLAETILSGKEDFGPRPEPPVTSVEEFYGGIFESPSSPDNKPFERQIPVAAVKTMSELELAILFNIILFRNVQPSAWGVLRTTLVPITISSALQRLLHRVLAARLSKLISLSSSQRGFTEIDGTLANALILHEYLQYRRQTGRTYHVVSLDVRKAFDTVSHCSVSRALGCFGIPSVIREYILATFGAQTTIKCGSVTTRPIRMLRGVRQGDPLSLVLFNFVMDELLEKVNEKYEGGSLQSGERCAIMAFADDLILIADRDQDVPAMFDDVSTFLERRGMSVNPAKCRALIAGAMHLSIWG

SEQ ID NO: 5 - protein, 1817 aa, Lasius niger
MNVGEDVAVLDVGRPNSHVCPICLRSFTSRIGLGLHKKKRHPVEYNEEICIARVKPRWSEEEIRILAMEEARAPPRTKSMNVYLWERGDESRSLESIKGVRRKQSYKDLVISYKDQLLAEKVDESLERQCSVPVVPAETPLPGSEAAMKWLVARVDDIIPEMNGGIWVRAAVCRLREGCLPDAALDDWWRNVFSDLETARSGRISRGPRVAPVLSKRRARRVEYRRMQQLWKVNMTKAAHKVLDGDTDSLPHPTLAEQLDFWRPVLEASSASFVRPVGAGKVVDGLESVWSPITEGEVINIRLPPSSAPGLDGLTVNRWFAEVPAILRATILNIFMATGRVPPRFSGSRTVLIPKSLDLMDPSCYRPISVSSVVLRHFHKILARRLAAFNLLDTRQRAFIAADGCAENIAMLSALLFDARANLRQLHVLTLDVRKAFDTVSHDAIRYVLRRNGIPAGMVEYLSTLCRTSTIRLEVGGAFSDELFPGRGVRQGDPLSPLIFNLVMNEILAVVPEQVGYNMLGHNINALAFADDLVLVAATREGAQRSLDRVVAALSDFGLELAPAKCAAFSLVPSGKLKKMKVLSDPQFAAGGCAVPQLGVLQTMRYLGVWFADAGPVDREVELLPLLDRITRAPLKPQQRLKILKTFLIPRFIHILVLGRTSYGLLRKLDRQIRAAVRRWLRLPEDIPKAFFHSPIASGGLGILSYETAIPRLVLARLDRLDKSQYDAARMVGSSAWAVRKRRWCGLAKRVEENWPAEFYGMVDGFELREAGNVTASTNWLDDPMIRVPSSEWLEYVKVWINALPTRIRTTRGSRRLREDVACRGGCGVQETAAHVIQQCFRTHGGRIMRHDAVASTLAGELQRGGYKVRREHVFRTPVGVRKPDILASKGERGYVLDVQIISGARPLTEGHKRKRNYYAGNAELLAKARESATTLTSLGVSKAVLRGITTRVLKGSFMNFARGPALTRQASVTSAEASSAHICDFPGCGRTFSTKTGRGVHQRRAHPDWFDGQQTTAMVKARWSEEETLLLARKEVELVRQGERFINQALFEVFPERSLESIKSKRKQPAYRDAVGTIMDSIAREDNAGVPLNVPVPDSANLKRNIEEHLSALPAPSSSAFMSARLAGICDSLTRKSQVAVVEELSLYLRSVFPIKPRGARPSGNVVTDAPSKRQERRAEYARAQDLWRKNRCKCLRMLLDDITGVNVPPKETMVPFWETIMTGNFPTSPGCDVLAPATNDLWLPITALEIRRALPAGTTSAGPDGLTARFLRRVPMEILERILNVILWCEKAPTHLMESATTLIPKKSNAHTPSDFRPITVSSVLLRTLHKVLATRMARLVQIDQRQRAFRPTDGCSENVFLLDLILRYHHRHHKPLFMASLDIAKAFDSVSHKTIEETLAIMGIPSPMRAYIMDVYQRSSTVLCCGSWTSRKIQPTCGVKQGDPMSPIIFNMIMDRMLKQLPGDIGTRIGGSTINAAAFADDMLLFASTPLGLQKLLDKSTDFLRKCGLQVNTSKYMTISLRNVPREKKTVVDRETVFLCQDKVLPALKRTDEWNYLGIPFTPKGRMKLNIAQKLQSSLDKLTKTPLKPQQRLFGLRVMVIPGLFHQAELGNINISVLRKCDRLVRCRVRQWLSLPSDVPNAYIHANVKDGGLGITALRWTHTGRIKRHDAIVSFVSRLLEVQGYDVSVEPRIKSDHGLKKPDIVAKLGVTAIVLDAQVVNDQISLDEAHQRKIDYYQDIEGNVKETFRVQNVIYSSITLSWRGLWSQKSVNSLTDLGIIKKKHIKIISTRAIIGGLTSFHIFNKATYVQGRAG

SEQ ID NO: 6 - protein, 1009 aa, Rhynchosciara americana
MSNYNETNTSGGDNPRMATQTTGSLSSGPINQHTCELCCRTFGTRAGLGQHVRKTHPIESNQSINVERKKRRWSPEEIRRMANMEAQATINNIKHLTQYLATYLPQRTLNAIKGRRRDAEYKELVTGIIANLRSNSSTQQTNQVCNESEMSQRSKILQSIRESVRDLRSRRNKYAKALQELGEAALCGKMLNEEQLIHCIKSMFNTAKCPKGPRFRKTATHSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKTLIYNLLLYYEKVPHKLKVSRTVFIPKKKDGSSDPGEFRPLTICSVVLRGFNKILVQRLVSLYKYDERQTAYLPIDGVGTNIHVLAAILNDSNTKLSELHVALLDITKAFNRLHHTSIIKSLVGKGFPYGFITFIRRMYTGLQTMMQFEGHCKMTQVNRGVYQGDPLSGPIFLLAIEKGLQALDKEVGYDIGDVRVNAGAYADDTDLVAGTRLGLQDNINRFSSTIKQVGLEVNPRKSMTLSLVPSGKEKKMKVETGKPFRANDVPLKELSINDFWRYLGISYTNEGPERLSLTIEQDLERLTKAPLKPQQRIHMLNAYVIPKYQDKLVLSKTTAKGLKRTDRQIRQYVRRWLKLPHDVPIAYLHAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTARGRPQKETSCRGGCKSTETLQHVVQQCHRTHGGRTLRHDRIVGLLQHELRRDYNVLAKQELKTGIGLRKPDLVLIKDDTAHIVDVQVARCSKLNESHVRKRSKYDKKEIEVEVKSRYRVSKVMYEACTISYKGIWDKQSVMSMRRLGVSEYCLFKIVTSTLRGTWLCWKRFNMITSVRS

SEQ ID NO: 7 - protein, 1041 aa, Eyprepocnemis plorans
MVGPTTRSKKGTGPPTGASVPTTESASQSSGAGRALLPASCPLCQRSFTTVNGLGQHRRRAHPEVVNAEIQTDRKKARWSKEELMRLAHAEARLVIEGCRFLNQELLKSFPDRTLDSIKGQRKGKAYRESVASFVSQLRSSVASAGPSGASPVAEEPLPGSPSVSQDDEVDAAIWSALADLPSSGSRFKLVDDIVALGPNTSRDIVRSMLPSALDAVGSKEPAAHPPLPFGARRPPDKKRARRRWEYAAVQRAFRKNAARCVNGLLDGTLLHQPPSIPGLVEFWKDLFTAPCASSRPRSKEGLSPMLLASSQPVSFRDLWAPITSEEAAAALPPRNSAAGPDALTPAQLRRLPHPVFLKILNLFLLARSLPSRLLRARTTLLPKKTSPASPADFRPITVCSVLARAFHKVLAGRLMRYCVLDGRQRAFIPQDGMLHNSFLLDLAMAHSRRTACSLYVASLDVSKAFDSLDHGALSPVLRAHGLPVEFVEYVRGCYQASTTVICGGGSSSDLVRPSKGVRQGDPLSPILFNLSIDLLLSRLPGYIGARIFSRRVNAAAFADDILLFAETKGGLQELLSTATSALGDLGLEVNPFKCFSLALVASGREKKVKVDNSVIFRAGNKNIPALAMGDTFRYLGLQFSTSGLSQFHPRQEVQEQLDIIKRAPLKPQQRLFALRSVILPGTYHGLALGRTRLGALKSLDVCVRAAVRAWLRLPDDTPIGYFHAPVIYGGLGIPATRWLGPLLRRRRLASMEGLGVIVDEPSQDILKREICRLDNYLKWDGDVIKTSYQLGRFWALRLHSSVDGAALRRSAQTPGQHSWVSNTRLMLSGRDFLACVRARISALPSRARLLRGREGDTRCRAGCNASETNNHVIQHCWRSHEARVERHDAVALYMVRGLRRRGYDVHRELHLRTSQGLKKPDIVAVSGTTAFVIDAQVIGDHLDADRCHREKVEVYDQQPVHTEIKRMFPEVQMITTTSATLNWRGVWSPASAKALIGIGFNSNHLSTMATRALLGSIMAARRFDSMTAPRRRMMPRTGVG

SEQ ID NO: 8 - protein, 965 aa, Nuttalliella namaqua
QTIRGLGQHIRIKHPTVSNAKISVATSKVRWTDEEIHLLAKEEARLIKLGKKYLNQELQSYMPHRSLEAIKGQRKSEIYKERVKHLVETKLLEVEPTMSEVLEPTESQKKDSFQKEIEKIITNTPPRKFQGERLWEIARKAIRGEDIYRDLNDYVVDTFVVATKPHPQAKGKSYTTAPPSSRRKRRRRLYGRMQEMMRRKPADCAKIVLDGERVASKINSEEFFDYWEKLTTKEPSNWPLSSDTAQRENLKDPMFPVTLREIKENLPSPHSAPGPDGCSARLLRAVPPLTLQLVLDLLLFVRRPLASLKGARTIFIAKKDAASHPKDFRPISISPILLRFLHRILARRLNRMVPIDKVQRGFQPRDGCAECAILLTMAIKESRSKLKSLYLASVDISKAFDSVTFEALDSALKRVGLSEGFIGYIRDLYTSGNTLFQFDNQCRTVVPTNGVRQGDPLSPFLFNIVLDEFFSTMEQEIVFDKNGLNLSALAYADDLVVFASSQRGLQHRLEEAYSFFKKKGLEINVEKSFTLSLQAAGKEKKIKVREDMRFNVAGMVLPALDINSVFGYLGVSFSPLGRPSETWEELKDYLDRISSAPLKPQQRLYILRGFLVPRLIYRLVLGRWTAGTLLKLDRQIRAAIRRWIGLPHDCPLGYFHAKIGSGGLGIPSMRTMIPELLLRRLTKLEMNETMGTKEIPKCESYWYYVKKMEDLTKYDGHKLDTKYACQRYWAQKLYKSVDGRDLEASSKVPFANHWILDHTRWLPGYEYCKMVKFKVNAMPVLTRTSRGLDRPRNCRGGCDQQESLKHVVQHCHRTHGARIKRHDNIVDFIGKRLAAKGYGVLKEPRVKTSTGILKPDLVVTGDDRVLIIDAQVVGSGQYLTEDHLRKVKKYNIDEVKDYFKEPRKCVAVTSVTVSFRGVWCANSAKELIELGLTKNDIKVVSAICLQGGVRAHSLFSNVTSVLKHR

SEQ ID NO: 9 - protein, 1031 aa, Triops cancriformis
MSQKRRPEKAVPDEGATAHDVAQPDKSKCSVCGETFKGPASVTMHMVKKHPVEFNELKMAKKPVPKKVRWSEEEIFQLARTEAELTLQGVRFINVELQKIFPAREIEGIKGQRKLAKYKELVKDQLDEIGRAPNPPEQEIGEDVPSPFKAWLELLLALPKTPNDFLEHKLDNIIVQALKEDVNSDQVFNDLNSYLKLILEPSGRAKSVPGEIIHGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPPSTAPGPDGFSSKDLRRMTPRVLNKILNLLLHLRDLPQILKSHRTVLIPKTDLPTKPGDFRPITISNILVRHLNKILANRVSHLIPINERQKAFLPIDGCAENIFTLDFILHHARTKIKSLSMAILDISKAFDSVSHHSIFRALREARCPIGFIKFIENCYGGCFTKLFCGGVKYPSEVSMNRGVKQGDPLSPVLFNLVIDGLIRQIPSALGFNVSDQVKVSCIAYADDLILIATTRAGLKTLLDLTNSYLAKRGLSLNPDKCSALSIVASGKQKLVYIASSEHFDLAGQKMRNLNVGDSWRYLGIQFSHLGRAEKVTPDLTCLINRLQKAPLKLQQKLYALRIYLIPRLIHGLTLSKTNLGELKTLDKLIRKYIRAWLHLPDDTPMGYFYTPLKAGGLGLPSLRLVILNNRLERILRMKASQDIIVRTIAESETLGVEIRKLHDLLSIDGTILDTSVKIHSFWAERLYSSYDGKCLCNSANFPPGNKWIGEDSLNQRSHIFADCLKLRINALPTRSRTARGRPLKDKPCRAGCRNSDGVKVIETLNHITQVCERTHGARVKRHDRLVDFAVKGLQRPHRVVLKEPHYKTVNGVRKPDIVIKIPDHTYICDFQVVSDTSCLELEFRKKALKYAEDKGLCDQLTRDHPGELSFTAITFNTRGLIAKSSVTALRKLGMPPRSIMTLQKICMEGSLEIWRIFNQTTAMARN

SEQ ID NO: 10 - protein, 1104 aa, Ciona intestinalis
MGEWPWVSWSLTVLVEKWRPFTILQPYPMPGQLRVDVYLPRKTSYLMDKNIYENTTSPGGGPLCGEKTHRSDVIIPPPGFAPSTDTASNTLGENVDASATTSSANPLSQEPGWCESCSKLFKSQRGLRVHQRSKHPELYHSQNQPLPRSKARWSDEEMVIFAREEIANRKIRFINQHLHKVFPHRTLESIKGLRGKNVRYARIMADLEAEMTSQPEAATSLCTETSENLASSNVLPQTRGWAENLVENIDTAHLANLGPLSQFEPGKPSSSTKEAINTEYNDWISKWLPSGAAHRERRANPPSTKLNARATRRLQYSRIQNLYKLNRSACAQEVLSGAWKVQSGELNLKEVQPFWEKMFRKESAKDRRKPKPTGEVLWGLMEPLTIAEVGSTLKSTTPSAPGPDKLTLDGVKRIPIAELVSHYNLWLYAGYQPEGLREGITTLIPKIKGTRDPAKLRPITVSSFICRIFHRCLAQRMETSLPLGERQKAFRKVDGICHNIWSLRSLIHNSKDNLKELNITFLDVRKAFDSISHKSLGIAAARLGLPPPLITYISNLYPNCSTKLKVNGKISKPIEVRRGVRQGDPLSPLLFNAVMDWALSELDPRVGVQIGEQRINHLAFADDIILVSSTKIGMVSSINTLSRHLAKSGLEISAGKEGKSASMAIVVDGKKKMWTVDPLPRFKVNSQKIPALSITQQYKYLGINIDAQGARNDAARILTEGLAELSRAPLKPQQRLYLLRVHLLPKLQHGLVLSSCAKRALTYLDKSVRSAIRRWLTLPKDTPTAFYHAKACDGGLGITRLEHTIPILKRNRMMKLTLSEDPVIMELVKLTYFTNLLHKYSNVKLLNSWPVTDKDSLARAEASMLHTSVDGRGLSNCSDVPRQSDWVTNGASLLSGRDFIGAIKVRGNLLPTKVSAARGRQREITCDCCRRPESLGHILQTCPRTWGPRISRHDSLLKRVRNQACLKNWTPIIEPSIPTNIGLRRPDLVLAKGNIAFLVDATVVADNANMQLQHEAKVEKYNNSDIKEWIKVHCPGVDEVRVTSLTANWRGCLYGGSASFLTEDLGLPKAELSLLSAKINEKGYYLWCAHYRGTARLWNRPLRS

SEQ ID NO: 11 - protein, 1046 aa, Drosophila mercatorum
FERRTGPVGYLPSGIEKLMVQMFNNEPRIAENNSVEYTPTVTRLGDHQVRNADANLQTMFPCRECERSFRTKIGLGVHMRHRHKDELDTARRRVDVKARWNEEELSMMARKELELTANGERFINKKLAEIFTNRSVDAIKKCRQRDNYKAKIEQLQGQAALISEANEPPTTQRRPSLSELEVTPSSSHSVPIAPPPIHSDDILLQELQGMSPVAVRRSWRVEVLQSIIDRAHISGKEATLQCLSNYLLEIFPNRNDRPSSATVPARRPRNRRISRRQQYARCIKSLLDGTDESALPNQSIMEPYWRQVMTQPSPSLCSNTVPRKGNMQEGVWSPITSRDLQVHKVPLTSSPGPDGITSQTARSIPIGIMLRIVNLILWCGDLPVPFRMARTIFIPKTVRANRPQDFRPISVPSIVVRQLNAILASRLTAAVSWDPRQRGFLPTDGCADNATIVDLVLRDHHKRYASCYIATLDVSKAFDSVAHDAVFNTVTAYGAPKSFVDYVRRWYSGGGTYFNGGDWRSEEFVPARGVKQGDPLSPVLFNLIIDRLLRSLPKDIGVHVGNAKVNACAFADDLMLFASTPKGLQELLNTTVKFLSSVGLTLNADKCFTISIKGQPKQKVTVVEQRTFCIGRARVQLKRSEEWKYLGIHFTADGRARYNPSEDIGPKLERLMQSPLKPQQKLFALRTVLVPQLYHKLTLGSVALGVLRKCDKLVRSFARKLLGLPLDVSVAFYHAPHSCGGLGIPSVRWIAPMLRTKRLAGINWPHLEQSEVASAFLSEELRRARDRAKAGVNELLSQPKIDTYWADRLYTSVDGNGLREARRYAPQHGWVSQPTRLMSGKAYRTGIQLRINALPTRSRTTRGRHEMNRQCRAGCDAPSHNHVLQRCHRTHGSRVSRHNGVVSYLKKGLETRGYTVYSEQSLHGQNRVYKPDIVAFRHDSTIVVDAQVVTDGLDLDRAHQSKVEIYNRQDLLTTLRSVYRARENIEVVSATLNWRGIWSFQSITRLRTLGILTAGDSNVISSRVVSGRVYSFKTFMFHAGFHRGMA

SEQ ID NO: 12 - protein, 1033 aa, Forficula auricularia
LGPRSINQPRIRTDSPNIVRPSGSTTTMQRCTTSDLTFSQCRFPHCKFRRPSLTGVRVHEQRSHKAFFDRLQAEVIRNQTSKKKPRWTEEEKNLLALAQANLIIEEETNIIDDLVSKFTYRTKDALKSQIRKPEHKTRVSEFTLAIQAHIDNIMLPAPVPIATDPLQVSCNFKDRAKDYIDTLEPITSTKFYLDELEALCDNICIWPTRLLITTVESYIRKLFKTTSTLKPAQKLHNPSNRNLPKRQLRRMEYGKTQKLWKKNPCRAIKTIIDDKDCKSPPEREAMTQYWKTTFSSKKRTCPQYEPRESTKTQLWEPVTIEELHCCHLEMTTSPGPDGITVRQLYLVPEQLLVRILNLLMACGKMPDSFLESKTTLIPKKPNSTEPGDFRPITVQSVLVRQLNKILAARVAQHIPLDERQRGFRPVDGVAHNIFELDMILRCHRSEFRDLRLASLDIAKAFDSITHNTIEDTMEVRGFPKPMINYIMACYRRSKTRFTFNGWISDTVKPTCGVKQGDPLSPILFNLVMDRMIRKLPKEVGVNVGSKHYNGLTFADDLLLFATTPEGLQSSIDIVHLFLLECGLLINKQKSFVLTVKAYPKLKKTAVIVTEKYMLDRHILPAIDREKLFHYLGVPFTAEGRCRDDTIAHLKRKIDVLTKAPLKPQQRLFALRVVILPSCYHILTLGGSNLSLLKKIDLMVRAAGRKWCCLPKDTPNAYFHASSRDGGLGLPSMRWLIPLHRYLRLLRYEGRNPEDTNVYLTTEINRAKIRLSDNGSNIDCQAKLWQFWADRLYKSVDGSALIESSKVPQQHRWATGGSRFLTGRDFINSIKLRINTLPTLSRTLRGREGNRMCRGGCYNVETLHHVLQVCHRTNGTRVKRHNAIRQYIARGAAVKFDTVEREPRIKSASGAVNIPDLVACNSDEVVVIDTQIVWDQANLDEAHQAKAEKYAHLSDILKHKYSRDRVKFTSVTLSFRGLWSKQSLKELTDLGIVNSKDIQIISTRAIIGGIASFRMFNSTTSVNSVNSFLEIALG

SEQ ID NO: 13 - protein, 998 aa, Ciona intestinalis
  MOD_RES (62)..(62): Any amino acid
MPGCQSVVGSECSQCGRVFKTARGLSVHRRSKHPEAYHREHIAAPRVKARWSEEEMILMAQXEVQAPAGTRFINQYLHALFPSRSLDAIKGARGKSAAYKKIILEQRLAALVPVSPPNQISGAESPSQPSNTSQEVRQDPEERSLRLRDAIDLGHLRTDFDMTAVNPGHPDPVIREEIDREFLRWLEPNRRRRGYAKATRIALNAPGKVRRRAEYAAMQRQWKTKRGLCAREALEGTWKIPARTVSLSDQEAFWRPLMESQSKNDLREPAKVGETLWGLLDPITPDEVRQILGSMSSKAPGPDGHRLSDLRSIPIDQICSHFNLWLLAGYQPKALRMGESCLIPKVKDASRPQQFRPITLGSYVGRCLHKCLASRFERDLPISIRQKAFRCMDGVAENVMILRSVLDDHKKRLAELNLVFLDVSKAFDSVSHRSILHAVKRLGVPPPLLKYVEELYADSETFLRGSGELSPSIKVRRGVKQGEPLSPHLFNAVIDWALSSLDQSFGVTVGEARVNHLAFADDIVLLSSSQPGLQRLIDQLTTHLGESGLRVNSTKSASIRIAVDGKNKRWVVDPRDSVHVGGVRIPAVAVSGSYRYLGVNISAAGMRVDAADSLASKLANLSRAPLKPQQRLYILCTHLLPSIYHQLVLSSTSKKFLKYLDRCVRVAVRRWLRLPKDTPKAYFHAKCNDGGLGVPELQRVIPLQKAGRWLKMTRSQDPVVQAAVGLEYFQKLLERWSTPELYQWGGGGITTSGHLAVAQARSLYSSVNGRGLRQSGLVSTQFDWVRSGCSLLSGRNFIGAMQLRGNLLATKLRASRGRPRVDISCDCCRTPESSGHILQVCPRTSWGARIGRHDNVAKLVARESAKRHWKVIREPAIPTPAGIRRPDLVFSKGDTAIVVDVTIVPDNAELSDAHSSKVSYYDNGAIRGWVALNTGASHITFSSVNNNWSDCMAEESKRMLKLGLGLPNSIRGTISAVVLEKGFHMYLCFKRGTFRASY

SEQ ID NO: 14 - protein, 1054 aa, Bacillus rossius
  MOD_RES (178)..(178): Any amino acid
  MOD_RES (308)..(308): Any amino acid
MLASSFKKKPRMVSSSKSGSSCNDAPTGVVVPASKESVESPSLDKKVGYGCEFPGCPRVFTTKTGRGVHHRKAHEDWYDARQKLDYVKARWTREESALMAREEAKAGTQSAKKMNQVLQLVLPDRTLESIKSHRRSAQYKELVLQAMGALSDSGKCAGPSQLANAELSTPLSSAVLGXGEPGGGGSGEHGSGDVPGSSRGEHLSALLDGLQPGPVVDRLRLIVRSVDDWSRARLHQEIGWFLRDLFWKPLTPNLARVSLPSKDKVSRRRLRRADYGRVQRAWKRNRNTCLRDLLRDKRTESAPPEELXVPYWESVLRSGSSCTPGQRGRTAERTELWDPVSSKEVEQALPPLGTAPGPDSFTPKDFRAVPSAVWACIFNIFMLCGRLPDYLLESRTTLIPKRDGACNPEDFRPITVSSVVVRCFHKVIANRMSRHIQLDPRQKAFRSLDGCSEGVFLLDFILGHARRNHRPVHLASLDVAKAFDSVSHAAILDVLRSFGVPDQMVEYIASVYAGSRTRLQGDGWQSHAIHPTCGVKQGDPLSPMIFNMVIDRLFTLFPRDTGVSVGDTVLNGMGYADDLVLFATTPVGLQQLLDITAEYLSQCGLRVNAAKCFSVSLAIVPHEKKVVVATKHRFKCLGQPIPALKRSDQWKYLGVPFSPEGRLKIDPLGRLKDELEKLRRAPLKPQQRLYALRTVVVPGLYHLLVLGGTTISSLNRLDIAVRSTVRKWLSLPHDVPNAYIHADARDGGLSIPSYRWTVPRLRFHRLKALSVLCDGGGPDEMVACVGDEIKRASARLQDHGMNINTRNTYRVRFARLLHTSNDGAPLKGSKKVEGQHRWVTDGSLMLSGRDYIACNWVRINSIPLRKRTARGRVRDTRCRAGCDSTETLHHVLQQCHRTHDMRIKRHNACVKYLLDRQRSRGKTVFWEPHFHTAGGLLKPDSVILHDASTAVVVDALVAGERSDLDREHDRKVSKYEPLVDLVKDRYSVDKVIFSSLIISARGVWGGRSFRHLSKLRLLDISDAKVLSTRVLLGGMGAVRVFNRRTAVSGRVNGW

SEQ ID NO: 15 - protein, 1020 aa, Lepidurus couesii
  MOD_RES (757)..(757): Any amino acid
MSGKSSKPRTVSSGSSSQETPPSGSNACDICGKCFMKPVGLSLHMSKVHPTQYHARLEKNQPKAKKFRWTDEDLYFLAKKEAELLLLGGIKFMNKELAEFFPEKSVDQIKGQRRSETYKQQVVSIHSELLKLQAVADSPPPSRIPAKEVSAWLDFLLALPKTKNKFSEDKLDQLIRTAQEGTPVLNDLDLYLREVLVQPTRQGERQAKPLPPPKSSREKRDREYARVQNFYRKNKTACVNAILDGNKKCENKIPDIDEFWKAIFESQSPPDAEPVSYVVDEEPKNIWSWISFFEMNRNYPDTSTSPGPDGVTARMLRSIPARVLNKLLNLLLFIEDLPAVFKCHRTVLIPKVDNPALPGEFRPITISSIIVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISTTKILMNRGVKQGDPLSPVLFNLVINEIIRKLPASIGYPINSELSINCIAYADDLILVANTREGLKLLLNLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPAIETINHIAQVCPRTHGARIKRHDRLVQFLSLNLRKNPKRNVLVEYNFRTVAGIRKPDIIVIEDTRAAILDVQVVGDSSNLEMEYLEKSRKYSNDATLSMRINALQKLYPTVTSLTFHAVTFNNRGLIAKSTVAALRMLGVPPRCIMILCVISLEKTLEVWRMFNQSTASARK

SEQ ID NO: 16 - protein, 1045 aa, Lasius niger
MGGSPPASFRRRPGKEGIPAPPGPWGCQPLGLVLVGPKNRNQASDNSGGPSGPSAPANPPSQVDDADFRCEFPGCNRTFPTNRGRGVHHQRAHKDWFDARLQPAVDKVRWTAEETAMLARKEAELTVESNPRFINQELLQYFPQRTLEAIKGKRRNQEYRELVEEFVEEFRNPDVITIEDDEEDEEDQRDIFLDYLESLTRPQGREFQATRLHNIAMEARTSGKDATLQKIALYLREVFPAPPPRRERRRKKTPNPAPMRKREARRCEYGAAQSLWKRDRRHCITNILNEMGPVNQPPRETMEPYWTRMMTTDGRTSPPSDKVPIKEDIWTPITGNDIKRSRIPRASAPGPDGISARLYRSIPTTVIIRLFNLLLWCERLPEDLLLSRTIFLPKKTNASEPGDFRPITIPPVLVRGLHKILAKRLETALDIDPRQRAFRSMDGCADNTLLLDTLLRYHRKQYKSLYMASIDVSKAFDAVTHPTIESTLISLGVPPPMIRYLGQVYANSRTRIEGDGWTSKPVHPKRGVRQGDPLSPILFNAVTHRLLQRLPREVGARLGNIPINAAAYADDLLLFASTSMGLQQMIDTMTDYLAECGMTINVEKSMTVAIRAAPHLKKTAVDASLSFSCGGRQLPSLKRTNKWRYLGVVFTPEGRAQCRPAEVVAPLLGALTKAPLKPQQRLYALRTVVIPKLYHQLALGAVTIGTLNKTDRLVRGALRKWLALPHDTPNAYFHTSVRDGGLGIPAIRWTAPVQRRGRLLGVMKALGQQGLDRFIQDELNTCKKRLTDHGVLLGTPEMVAKRWAQQLYGSIDGAGLKDSAKTPHQHQWIADGSKFLTGKDFINCNRARIGALPTRSRTTRGRPQDRRCRGGCLAQETLNHVLQHCHRTHGQRIKRHDAVVKYIARNMPRSGYEVHQEPHYKTELGLRKPDLVAVLGQTAIIIDAQVVSEQTNLDDAHTRKVAYYNEPATIRAIKAEHGVRTVKVTSATLSWKGVWSPRSAEELRKLGFIRAGDAKVVATRVLIGNIAAFRTFNATTSVEHRAGIG

SEQ ID NO: 17 - protein, 1016 aa, Lepidurus couesii
MSEESRPKQTASKRGAAVEKTMMSGTYVCTLCGRSFEKSVGLSLHTNRMHPEAYNKLKEAKKPVLKKARWSEEEVFLLAQKEAELSFIGGIKFMNIELHKIFPERELEGIKGQRKNPTYKAQVVSLLAEIRESKANDSSSSSSSSSSCDSASLGISNWLEFLLALPKTSNQFQEGRLDRLISDALRGVDVLENLDAYLLEVFAKPMAQNPCPKPPPPAKNSRERRDREYSRVQNFYKKNRSACINSILDGNTRSQNVIPGLTKFWTETFEKNSPPDDEAPDQFVADEPRDMYKWITFYEMSQDYLDSSTAPGVDGFSAKQLRSMSPRVLNKILNLLLLSENLPNSFKMHKTVLIPKIDDPKSPGDFRPITISPVLARLLNKILAARLSKLVPISQRQKAFLPVDGCGENIFLLDYILRSSKKSSKSVAMAVLDVKKAFDSVSHHSILRALNEAKCPINFINFVRNSYDGCTTKLTCGGTSFPDSVRMNRGVKQGDPLSPVLFNLIIDSAIRKLPDSIGYVIRDGLKINCLAYADDLILVASSRAGLKTLLNIVAEHLSLRGLDLNAAKCHGLSIIASGKAKTTYVSAADSLDLDGQPIKNLGVLDTWTYLGIPFSHLGRAEKVSPDLTNLLNKLQKAPLKLQQKLYAVRNFVIPRALHGLILSKTNLKELNTLDRAIRVFLRTLLYLPKDTPLGFFHSPIKSGGLGITCFRTSVLKCRLQRIARMRSSCDGVIQAVAESDIFADEYAKLRDLIRINGNVLDTTESIKRYWAQRLHSSVDGKTLAYMDYFPQGNLWMSEDKVSQRSYVFADCVKLRINAIPTRVRVSRGRPNKEMCCRAKCFDSQRMPAFESLNHITQVCPRTHGSRIQRHDKIAKFLFKNLNNCPSRSVLYEPHFVTVDGLRKPDIIIYDDSHMVVLDVQVVSDSANLEKEFECKAKKYANDVALRSAMLIKYPFIKSFSFVAATYNNRGLIAKSSVQVLRQLGLSPRSIMVSILICLEGTLETWRIFNQSTMNAH

SEQ ID NO: 18 - protein, 1151 aa, Anurida maritima
VGVQGEVTSLRLLCQQDSEVYATTMNRKNNYTRGNRFSSGSPGNFVVVRDPAQDLPFKCAFCERTFTTSNGKGLHELRSHPKEYNMRVPVAKKRARWSEEELSQLAEAEHDLKSKKQYASELDLSRDLEGCMVGRSLESIRGQRKLPRYVEIFNRLSNSRASIPEIGEGDEEANSVGSDEVFHASGHGTGITEALEVLVSKRPGEAFREEVLNGIVRAKLEGSEVFVRLEQYLSRMFVGQSSLASTPCSSGEGKLPLTCSGSNKKEQRSDLFSRFPEKGPSVSVSAPSVSDMGRKRRKALSRNEATQVREEFVEFARNVDPIPRRKCARVNEGLQGNQRLPKEKPMTARAKMRHLRLLRYRRLQELYKKDRSLAAKQVLQDMLDSKPGRNPEAVKYWAETMGKESTGIDVSVMTGRPRYRDNVWSPIYPGEVSAAVKLMDSSGATGPDGFSVRSLKCTPSRVLAKVFNLFLLEEKLPAFLMTSRTVLVPKVKEPKAPTDYRPISVSSTLVRLFHKILARRLTLASGLDSRQRGFVPVDGCAENLVVLESAIRSAKNYKRSLFVASMDIKNAFGSVAHEAIFEALSKSGAPDSFVTYVRNCYDGFASVVKLGRDTAQTTVRQGVLQGDPLSPILFNLVIDQIIRSLPETVGVQLDANTKLNSMAFADDLILLSSSEAGMRRMLGVLAGVSSKFGLIFHPGKCKYLAMIWAGKQKKMKIATDLSFEIGGGFMTPVGVTETWKYLGAYLGQIGIQPARLSLQTFLERIAKSPLKPQQKLYLIRVHLLPKLIYPLVMAPIRASMLNKLDRMVRVALTGKDGILHLPQSVPSAFFYAPIGEGGLGLMELRTSIPAMVKARFERMMNSTCHHVRAAAKGAANSNRIALANRFLRKTADGIPVTSAKLVKEYQAAKLHGSFDGKPLSEAGRVKGIHSWTCDGRMVMTGQAFCEALKIRINALPCLSRYNRGTEKPRECRAGCKTTESLNHVLQVCPRTHDMRVARHDKLVNRLGGYLSQKGFEIHTEPRIITSLGLRKPDIIAIKGEKGVVLDAQIGGAANLNAAHDAKMCYYSSSPEIKEWVTGKGAPDVSYGACIVSPQGIMSEESWKTLRGLGFSKGMLNSLVVTVMEQSTYVWHVFNRSTASYGWKRRRKRKWD

SEQ ID NO: 19 - protein, 956 aa, Lepidurus apus lubbocki
  MOD_RES (418)..(418): Any amino acid
  MOD_RES (436)..(436): Any amino acid
  MOD_RES (460)..(460): Any amino acid
  MOD_RES (494)..(495): Any amino acid
  MOD_RES (518)..(518): Any amino acid
  MOD_RES (586)..(586): Any amino acid
  MOD_RES (621)..(621): Any amino acid
  MOD_RES (697)..(697): Any amino acid
  MOD_RES (736)..(736): Any amino acid
  MOD_RES (745)..(745): Any amino acid
  MOD_RES (756)..(756): Any amino acid
  MOD_RES (760)..(760): Any amino acid
  MOD_RES (790)..(790): Any amino acid
  MOD_RES (867)..(867): Any amino acid
  MOD_RES (873)..(873): Any amino acid
  MOD_RES (885)..(885): Any amino acid
  MOD_RES (954)..(954): Any amino acid
MSEESRPKQTASKSGAAVEKTMMSGTYVCTLCGRRFEKSVGLTLHTNRMHPEAYNKLKEAKKPVLKKARWSEEEVFLLAQKEAELSFIGGIKFMNIELHKIFPERELEGIKGQRKNPTYKAQVVSLFAEIRESKANDSSSSVSSSSSVDSASMGISNWLEFLLALPKTSNQFQEGRLDRLITDALQGDDVLLNLDAYLLEVFAKPMAPNPCPKPLPPVKNSREKRDREYSRVQNFYKKNRSACINSILDGNTRSQNVIPDLMKFWTETFEKVSPADDKAPDQFVVDEPRDMYKWITFYEMSQNYLDPSTAPGVDGFSAKQLRSMTPRVLNKILNLLLLCENLPNSFKMHKTVLIPKIVDPKSPGDFRPITISPVLARHLNKILAARLSKLVPISQRQKAFLPVBGCGENIFLLDYILXNSKKKSKSVVMAVLDVKXAFDSVSHHSILRALNEAKCPVNLXNFVRNSYDGCTTKLTCGGTSSPDSVRMNRGVKQXXPLSPVLFNLIIDSAIRKLPDSIXYLIRDGLKINCLAYADDLILVASTRAGLKTLLNIVAEHLSLRGLDLNAAKCHGLSIIASGKAKTTYVXALESLDLDGQPIKNLRVLDTWTYLGIPFSHLGRAXKFSPDLSNLLNKLQKAPLKIQQKLYAVRNFIIPRALHGLILSRTNLKELNTLDRAIRVFIRTLLHLPKDTPLGFFXAPIKTGGLGITCFRTTVLKCRLQRIARMRNCSDEVLEAXAESDTFDDXYAKLRDLIRIXGNVXDTTENIKKYWAQRLHSSVDGKTLAYMDYFXQGNLWMSEDKVSQRSYIFADCVKLRINAIPTRVRVSRGRPNKEMSCRAKCLDAQRIPAFESLNHITQVCPRTHGSRXQRHDRXAKFLFKNLNNCXSRKILYEPHFMTANGLRKIDIIIYDDSHLVVLDVQVVSESANLEKEFTCKAEKYANDVALRSAILLKIXIY

SEQ ID NO: 20 - protein, 779 aa, Ciona intestinalis
KFKQSKVKHNQKENKSKRQIRRAQYARTQINYKRNRQQAINSILSKQWRELDDRGPPLEHVLPFWQKLLEKSSEHDTRQPEPVSGPIWELVEPIVAEEVRLVRKSMPTSAPGPDGIRHKDFMAVQPQILADNFNLWLLTGYQPKSCRLGRTILIPKEPGTRDPAKHRPITINSLLIRCFHKILSNRIMKLIPLSPQQKAFRPGDGIAEHIWNLRHILNQHKLEKKELNLAFLDVRKAFDSVNHSTLLLAAGRLGVPPPLLKYIENLYEGSSTTIIANGERSPRIRVRRGIKQGDPLSIPLFLGVMDWAMSNLNPNVGSSIGGKSINCMAFADDLVLISRTQIGLQTNLDTISYNLNQSGMTLNSEKCATLRLAVDGKSKKWWIDHRPFLRVEGAKCGAMDIEGTYKYLGVRVGAGDTRAECKEKLMSDLKETTEAPLKPQQRIFILRNYILPRSLHILTFTNTTARLLKQLDSAIRIHVRRWLKLPKDTPLGYLYSDYKDGGLGVPRLLSRVPLLRIRRMAKYNTSEDPTTVALRSCHTFTSAAVKWAMPPKISNVVISDKRKERDFHRSELATSIDGSGLSCANTTPRAHQWVVNGTGLLSGKNYIGAINARGNLLHTASRAARGRPQRTTDCDSCHRVETLSHILQSCPRTHGPRIRRHDKVTKVIAEAAGKKGWKTIAEPRIPTPEGIRKPDLILYQHGRAIVMDTTIVSDSADLSMSHQHKVIYYQNECIRSWVQEATGATEVTWSSFSANWRGCIADESRDLLLHDSTSQKTAA

SEQ ID NO: 21 - protein, 1257 aa, Schistosoma japonicum
MSAMLNITTECHPVSTGVNADPSFSYSSTCLCCFSSFASNSLLLDHATASHSANIVSPPSESGSFQLVCMLCSSHYLSSRGFTQHLRHVHPDAYNSLKCLRLNASPLTHRSWSSEEDVCLLSRADELSASCRLKVDLYNRLHTVFPSRSPEAIKKRLRFLSSSSESSSSAPSPSDISSAASSVSSLPVDLDAPTRSLIPTRRPARSHSSSILSFFTRTPRDVSSSASPVVLHSSPSTTIVINNASVRLHLDSPVSSHALESSCMSSLATNPLHIIDNQHLAASPPLSGVHCPSVPSSAPAAAHVDQSFDNPALGSTPVDSCPPVTSLTLLPAQLSDVAVNLMTSCPELIKPASPSPPLMDDNLLQLILPSDSPNMSPHIVPPPDVVVAPMCTDSTRELISAALRLITQNSPLMHAPTLREFLQAALVNMPDMIEIQLFLNSHAELQFPTKWRPSKPRLPPTYRANTSRKHLRRLQYGHIQTLYNRCRRDAANTVLDGRWRSPHTSSPFSIPEFETFWKTIFTTPSTPDNRPVVPVLPTCPALLDPITPDEITWALKDMRNSAPGVDRLSAQHFLNFDVPSLAGYLNMVLAFKFLPTNLSISRVTFIPKGASPQQPNDFRPISIAPVITRCLHKILAKRWMPLFPSSKLQFAFLQRDGCFEAINLLHSLLRHAHERHSGCSIALLDISRAFDSVSHHSILRAAHRFGAPDGLCQYLQRVYNGSTSLFNTVDCAPSRGVKQGDPLSPLLFIMSLDEALESIETVSPVIVDGLPISYIAYADDLVILAPNADLLQKKLDKLASLLQRSGLIINTSKSMSIDLIAGGHSKLTALKPTVFKIDGNQLQRLNVSDHFDFLGISFDYKGRSKMDHVETLSAYLLNLTQAPLKPQQRMSILRENLEPRLLYPLTIGVVHKCTLRQMDCLIRSSVRKWLRLPSDTPTSFFHSSISTGGLGIPHLSSIIPLHRRKRAAKLLLSPCPIIRWVSQSPSFSNFLRICNLPINVHRDLIHSFDEARCSWSKQLHSTCDGRGLSMSSRNTVSHLWLRYPEHIFPRLYINAIKLRGGLLSTKVRRSRGRQENADLLCRGRCGHHESIQHILQHCSLTHDIRCRRHNDICRLVASRLRRNNIRFFQEPCIPTPVSFCKPDFIIIRDSIAYVLDVSVCDDANVHLSRQLKINKYGCSTVVSSIYNFLNATGLRISSVRQTPLIITYRGLIDPLSTTSLRRLSFSSRDISDLCVASIQGSMRIYNTYMRGTSPQDP

SEQ ID NO: 22 - protein, 1856 aa, Opisthorchis viverrini
  MOD_RES (1577)..(1580): Any amino acid
VLVTFDNVYYESSGASAPVPTSTQERLVGFTCEECGKCCKSKAGFVAHHRVHDNESVGTNTVAQLACADCSRLFPTKIGLSQHRRHAHPTQHNADKLGRVKYSGTRWSQQESQSLLRLANNLYPSCGTQTELFTRLEQYFPGLSAISIETRLRVLNWQAQQDESSSGEPERIIGLTTADSSEADGYNVWFKQTVDCTVSLLESHAHRALASVDLLAFARGLQSGIMTPEQVLSLLDLHAFRTFPHTWKTVSRRRRQLAHRIPVNRKQIRRANFAAIQTLFHQRRKDSASAVLDGSWRDLYKGNCGLPTNAERPWKQVLSAPKRAGSRPSRIVVPSDWSLVEPITGEEVGRTIRLMGNSSPGLDKLTPRTLRRFNANVLAGYFNLFLLSGGCPPHLCRARITLVPKVPHPTSPDQLRPISVSSILVRCFHKFAFLHRDGCLEATSLLHALLRHSSATASNLSLAFVDISKAFDSVSHDTIVRSAKAFGAPSPLVRYIAQSYENAVAVFPSSEVHCHRGVRQGDPLSPLLFIMAMDEVLGLSMPQLGYQFHDTLVDGFAFADDWVVCAESQARLKEKLEAAAVELGRAGMKINARKTKVMVICGDRKHRATAVSVEPFRFAEELITPLGPTDTVTYLGIPFTSKGKGVFNHRQHLLKLLEEVTRAPLKPHQRMDITRNYLIPRLTYSLVLGQVHRNTLKRLDNYIRQYIRGWLRLPKDTPISYIHAGKQHGGLGIPSLSATIPMQRKTRMEKLLSTQCRVLRNVVNDSAFGKIVRDLSLPIRVHGACVNTKEELVAAWGESLHNSADGRGLRELVTSPLSNRWLVFPERVFPRIFIRGIQLRCNLLRTRVRSARHGHGGQTILCRGNCGQPESLVHILQSCWITHDARCARHNRVARELAKRLRRLGYTVFEELRAPTSTSFIKPDLIAVRDRRATVIDVSIVSDGRGVIVWNEKKQKYGADEHSLAIISALHAIGCDINFSVHQPMIISYRGICFPQSAKAVIGLGLLRSDVSLFSPIFPRYSFTFKTRIHFLSQVGKTTLILSLVSEEFSPKVPAQAEEITIPADVTPERVPTQIVDYSSRTQSHEQLCAEIRRADVICLVHALDDEKSLERISSYWLPLIRHNGANPDCHSPIVLVGNKLDLLNESKLSKALPIMSEFSEVETCIECSAKTLLNLSETFWFAQKAVLYPTAPLYDAERKELTPACIRALTRVFRICDTDNDGYLSDRELEAFQSRCFSVPLTTQSLQDVKQLVRQSCPGGVTLNGITQKGFLFLHLIFVQKGRHETTWTVLRQFGYDNQIRLSNEFLFPRFSVPSGCSTELSTLGIQFLHMLFNKYDLDRDGCLSPSELSEMLAIFPEDQLSHVSELTDSVTTNSTGWITCQGFLAYWALTAYLEPTRVLEYFAHLGFTYFAAGSFWSTVNSHHQQQQHPKDPYDGTPSTPLLIGALPLRDRLIGQNPPNSSGRSDAGGSSVPMSRNTRDALLRSLVITSEKRLDTIRRSTQRTVFYCRVYGARKVGKTCLLQGLLGRHLRGTGGLAIGGLSGRSSGWAAATGIQVYGQQRTLIMHEIGAAGGEQXXXXGGPRRIQVYGQQRTLIMHEIGAAGGEQMTAGEALSADVACLVYDVSDSDSFRYVANLFLNYYRGTRVPCLFVESKSDQPRVVQNYQVDPIELTTKYNLNPPEPFSSMNLEQCLNALASNSTRNVASSLGDPVSRSRSATNLFPNPMPSRRAGSLEPSSSTAGGETHLLKDSSHKLSPGIGLSLLSLEKESVQLNPPLDARGRRHSKPDLAYRPSMEFSARDTNFLPVYVTLCTLANYPHLRGLQLAQTDYAWKWTLAATILAGFGFVAFRIAKTHF

SEQ ID NO: 23 - protein, 493 aa, Hippodamia convergens
AFADDVILCGTTSWGLQRNLEIFEEELRRSGLSLNPGKSKCVSLVASGREKKVKLVMTPTFRASGSWLSQVDGTTFWKYLGLQFRGCGMAGCGSDDVAECLERLTRAPLKPQQRMHLLRVFLLPRFYHVWTFGRLNAGILRRLDIRVRNAIRTSVRLPHDVPVGYFHAPTNAGGLGIPQLSRFIPLLRLKRFERLAHSSVESVRECARTEPAVAKVRWCRERLADVVDRVADGTQSLREFWTRELYRSMDGRALRESVRETPSTQWLRCCTRVIPARDWLNYISVHINALPSRVRTSRGRRDGVDVTCRGGCLTAETPAHCIQVCHRTHGGRVLRHDAIAKALSVHLTQRGWSVRREVSYQTVVGVRRPDIVLLAGREIAVVDVQVVAPNPSLDSAHRKKVAKYRDEAQLATCLVRGASVQPRRRAEEETQVRFASATISWRGVWSSESARSLRELGLTDRELAQYSTYDLRGSWMNWVRFGASTSTRMAWRP

SEQ ID NO: 24 - protein, 510 aa, Amblyomma americanum
PLFFNLVIDEFLEGLNHELAYRCQGLQVSAMAFADDLILAASTKDGLKEHTRKLENFLSQRGLRANAEKSSTLVILPSGRGHKSKICPNITFQIHGKDMTSQNCTSLWRYLGVTFSATGRIQGPIRFELAALLQRVSSAPLKPQQRLVVLRYYLMPRLTHRLTLGPISAKTLTAIDRTIRSNIRRWLALPLDVPMGFFYAQIEQGGLGINCLRTTIPSLRLRRFAKMTHSSNSACTFAATRRTVTDSIHQAERLCVFKGQTLRNPKESGRFWSSQLHASSDGRSLQGCKNAKGSTYWLREGTSFLKGREFIDLTKFHTGAMPNLTRLKRGRDVPKKCRAGCESEESMGHIQQRCHRTHHTRIERRNNLVKYLSKRLHDLGWHVKVEPHYATSQGTRIPDLVIKRDSQALILDVQVVGTRVGLTQAHEAKTNKYKIPELLMSMDPRPSVSSVTTSYRGVWATQSVGILTDIGLGIHDFKIMTIRCLQGGLRSFRTHQQMTSVRRDGNFRAV

SEQ ID NO: 25 - protein, 513 aa, Ixodes scapularis
PLLFNLVVDEFLQTLDPGIGYSSDQLQLDGMAFADDLIVFASTPEGLQRRLDSLHSFVGARGLAINAEKSFTVSIVPSGREKRTKVVTTGNFSVSGIPLPACGIEARWKYLGVEFSPNGRNVPLTKDVASMLERVAKAPLKPQQRLVILRFYLIPRLYHRLVLGRWNRKLLKRLDVQIRDAVRKWMALPHDTPLGYYHAPVAEGGLGVGSFSTAIPWMQVQRLPRMATSSSPICRQAADTYMVKTALDRAKKACVVRGNILSDKQSVGKHWSALLHASNDGHALREVGRSPAAQRWVQEGTGLLTGRAFIDVNKLRINALPVRTRTKRGRDTDKNCRGGCRAPETLDHVLQKCHRTHAARIKRHDGLVQIVVDRLRKKGWTVEVEKRFNGPQTLIPDIVARRVLRENTPLEKRESAVIDATVITCGYPLLKAHESKVRKYDVPQVTSICKGKNTEHPLVTSATLNFRGVWCKQSAQDLLSLGLTKQDLKIMTVRCLQGGIHCFRVHHGMTSVK

SEQ ID NO: 26 - protein, 1005 aa, Trichinella britovi
MAHWYASLIRLIAAGTFIGERPANSENSQMPCHLISDATCGFSFATFSGLHLHRKRAHPDVFAAACGKKTKVRWSNDEISLLATLEAGLDPACKNINQVLAERLMEYDITRGVEMIKGQRRKEQYKALVRQLRSKSVTQQCVGFAGSMDSNVPVNDTTSSVASEVTITYPEYGAVMSCDLIKEATGMAMVDINELQSNIRKVFSSGRKLPVKSRGARETVQKKMANPRVAKYKRFQRLFRSNRRKLASHIFDKASLEQFGGSIDEASDHLEKFLSRPRLESDSYSVINGNKSIGVAHPILAEEVELELKASRPTAVGPDGIALEDIKKLNSYDLASLFNLWLKAGDLPESVKASRTIFLPKSDGTTDISNCRPITIASALYRLFSKIITRRLAARLELNVRQKAFRPEMNGVFENSAILYALIKDAKARSKEICITTLDLAKAFDTVPHSRIVRALRKNNVDPESVDLISKMLTGTTYAEIKGLQGKPITIRNGVRQGDPLSPLLFSLFIDEIIGRLQACGPAYDFHGEKICILAFADDLTLVADNAAGMKILLKAACDFLEESGMSLNAEKCRTLCISRSPRSRKTFVNPAAKFNISDWKTGISSEIPSLCATDTFRFLGHTFDGEGKIHIDMEEIRSMLKSVRSAPLKPEQKVALIRSHLLPRLQFLFSTAEADSRKAWLIDSIIRGCVKEILHSVKAGMCTEIFYIPSRDGGLGLTSLGEFSLFSRQKALAKMAGSSDPLSKRVAEFFMERWNIARDPKVTEAARRVYQKKRYQRFFQTYQSGGWNEFSGNTIGNAWLTNGRARGRNYVMAVKFRSNTAATRAENLRGRPGMKECRFCKSATETLAHICQKCPANHGLVIQRHNAVVSFLGEVARKEGYQVMIEPKVSTPVGALKPDLLLIKADTAFIVDVGIAWEGGRPLKLVNKMKCDKYKIAIPAILETFHVGHAETYGVILGSRGCWLKSNDKALASIGLNITRKMKEHLSWLTFENTIRIYNSFMKN

SEQ ID NO: 27 - protein, 510 aa, Rhipicephalus microplus
PLLFNLVIDEFLAELDPQLAFTSEGMKVSAMAFADDIILTTATHWGLKQQIDRLNSFLGARGLKINAAKSTTLVIEPSGWQKRSKIRTDIDFFVNGERLATTNCTSTWRYLGVHFGVKGLEKGLVRRQLAILLERVSKAPLKPQQRLVVLRFYLLPRLYHRLVLGPILAKTLLTIDRVVRSAVRRWLALPLDAPLGFFYAAVEEGGLGVPCFRTVVPAMRLRRYQTVAQSSNPACAFAATRPTITQLKRQADNLTIFKGTKIGNSKQSRKYWARQLHMSFDGRPLQQCKEAPGSTSWLGNGTSLLRGREFIDLAKFHVAAVPNLTRLRRGRELPKQCRAGCQAEESLGHILQRCHRTHHARIKRHDNILRYLAGRLTELGWQVQQERHFKTSQGTKIPDLVIIKREKSHILDVQVVSTRVELTEAHHHKCDKYKIPDLLFQVSPTPTVSSVTLSYRGTWAGESVRTLQEVGLTRNDFKMMTIRCLQGGLAAFKMHQMSTAVVRRGVGSQG

SEQ ID NO: 28 - protein, 1080 aa, Trichinella sp.
MSNRLANTAAAGGVPEKNSGTLDIPGQPSSSGEKRAISYPGPFGCNSCSFTSTTWLSVELHFKSVHNTREFVFLCSKCEKSWPSINSVASHYPRCKGSVKAAVVPSSLANTCTTCGSSFGTFSGLQLHRKRAHPDVFAASCSKKTKARWSNDEFILLARLEAGLDPACKNINQVLAERLMGFNITRGVEMIKGQRRKDQYKALVRQLRSNSETQQCVGLAGSMDSNVPVNDTTSSVASEVTITYPEYGAVMSCDLIKEATGMATVDINELQSNIRKVFSSGRKLPMKVRGVRETVQKKMANPRVAKFKRFQRLFRSNRRKLASHIFDKASLEQFGGSIDEASDHLEKFLSRPRLESDSYSVISGDKSIGVAHPILAEDVELELKATRPTAVGPDGIGLEDIKKLNTYDLASLFNIWLKAGDLPDSVKASRTIFLPKSDGTTDISNCRPITIASALYRLFSKIITRRLAARLELNVRQKAFRPEMNGVFENSAILYALIKDAKVRSKEICITTLDLAKAFDTVPHSRILRALRKNNVDPESVDLISKMLTGTTYAEIKGLQGKPIIIRNGVRQGDPLSPLLFSLFIDEIIGRLQACGPAYDFHGEKICILAFADDLTLVADSAAGMKILLKAACDFLEESGMSLNAEKCRTLCISRSPRSRKTFVNPAAKFNISDWKTGVSSEIPSLCATDTFRFLGHTFDGEGKIHIDTEEIRSMLKSVKSAPLKPEQKVALIRSHLLPRLQFLFSTAEADSRKAWLIDSIIRGCVKEILHSVKAGMCTDIFYIPSRDGGLGFTSLGEFSLFSRQKALAKMAGSSDPLSKLVAEFFIERWNIARDPKVIEAARRVYQKKRYQRFFQTYQSGGWSEFSGNTIGNAWLTNGRARGRNFIMAVKFRSNTAATRAENLRGRPGMKECRFCKSAIETLAHICQKCPANHGLVIQRHDAVVTFLGEVARKEGYQVMIEPKVSTPVGALKPDLLLIKADTAFIVDVGIAWEGGRPLKLVNKMKCDKYKVAIPAILETFHVGHAETYGVILGSRGCWLKSNDKALASIGLNITRRMKEHLSWLTFENTIRIYNSFMKN

SEQ ID NO: 29 - protein, 1126 aa, Trichinella sp.
MSNRLADTDAAGGVPEKNSGALDIPGQPSSSGEKRAISYPGPFSCNLCSFTSTTWLSMELHFKSVHNIREFVFLCSKCEKSKPSINSVASHYPRCKGSVKAAVVPSSLANTCTTCGSSFGTFGGLQLHRKRAHPDVFAASCSKKTKARWSNDEFTLLATLEAGLDSACKNINQVLVERLMGYNITRSVEMIKGQRRKEQYKALVRQLRSKSETQQCVGFAGSMDSNVPVNVTTPSVVAEVAITYPEYGAVMSCDLIKQATGMAIVDINELQNNLRKVFSSGRNLPAKSHGVRESVPKKMANPRVAKFKRFQRLFRSNRRKLASHIFDKASLEQFGGSIDEASDHLEKFLSHPRLESDLYSAISGDNSIGIAHPILAEEVELELKATRPTAVGPDGIALEDIKRLNPYDIASLFNLWLKAGDLPDSVKASRTIFLPKSDGTTDISNCRPITIASALYRLFSKIITRRLAAKLELNVRQKAFQPEMNGVFENTAILYALIKDAKVRSKEICITTLDLAKAFDTVPHSRILRALKKNNVDPESVDLISKMLTGTTYAEIKGLKGKPITIRNGVRQGDPLSPLLFSLFIDEIIGRLQACGPAYDFHGEKICILAFADDLTLVADSAAGMKILLKAACDFLAESGMSLNTEKCRTLCISRSPRSRKTFVNPAAKFIISDWKTGVSSEIPSLCATDTFRFLGHTFDGEGKIHIDLEEIRSMVKSVKSAPLKPEQKVALIRSHLLPRLQFLFSTAEVDSRRAWLIDSIIRGCVKEILHSVKAGMCTDFFYIPSRDGGMGLTSLGEFSLFGRQKALAKMAGSSDPLSKRVAEFFIERWNIARDPKVIEAARRVYQKKRYQRFFRTYQSGGWNEFSGNTIGNAWLTNGRARGRNFIMAVKFRSNTAATRAENLRGRLGMKECRFCKSATETLAHICQRCPANHGLVIQRHNAVVTFLGEMARKEGYQVMIEPKVSTPVGALKPDLLLIKADSAFIVDVGIAWEGGRPLKLVSKMKCDKYKIAIPAILETFHVGHAETYGVILGSRGCWLKSNDKALASIGLNITRKMKEHLSWLTFENTIRINNSQMPRHLISDAYEWINKIPSVPIYYLAKPQPRERAWQNQRGKKTLLSLTLV

SEQ ID NO: 30 - protein, 526 aa, Lepidurus couesii
KQGDPLSPVLFNLVINEIIRKLPASIGFPINDKLSINCIAYADDLILVANTREGLKRLLEILNEELPKRGLELNASKCFGLSLTALGKMKKTYLCSSSHLDLHGTLIKNLTADESWVYLGVPFSHIGRSKSFSPDLEALLNKLQKSPLKLQQKLFALRVYLIPRVLHGLVLSKVAMGELKIMDKLILKYLRLWLRLPKDTPLGFFYASVKLGGLGIKNLRTNVLKCRKQRIERMLVSPDDVVRLAAESEIFLKETVKLKDLLTYDEKCLDTTEKINKFWSERLYTSFDGKPLAYSEYFPQGCGWIREDKIAQPAHIFAECIKLRINALPTRSRLARGRPTKDRSCRAGCLDVQKEPAIESLNHIAQVCPRTHGARIKRHDRLVQFLCLNLKKNPKRNILVEYNFRTAAGIRKPDIIIIEDTCAIILDVQVVGDSSNLEHEYLEKSRKYSNDANFINAFQKLYPLVTNLSFHAVTLNNRGLIAKSTVTALRRLGVPPRCIMILCVISLEKTLEIWRIFNQSTAAARK

SEQ ID NO: 31 - protein, 521 aa, Drosophila ambigua
PLGSQGDPLSPIIINMIIDRLLRVLPNEIGATVGNAITNAERFADDLVLFAETPMGLQKLLDTTVDFLSSVGLTLNSDKCFTIGIKGQPKQKCTVVIPQSFCIGSRPCPALKRSDEWKYLGIHFTAEGRTRYSPAEDLGPKLLRLTRSPLKPQQKLFALRTVLIPQLYHKLTLGSVMIGVLRKCDIVVRSFIRKWLGLPMDVSTAFFHAPHTCGGLGVPSVRYLAPMLRMKRLSGIKWPHLVQSEAASSFLEVELNKARGRTLAGENELTSRTAIETYWADKLYMSVDGSGLREARLFRPQHGWVFQPTRLLTGKDYRNGIKLRINALPSRSRTTRGRHDLARQCRAGCDAPETNNHILQNCYRTHGKRVARHNCVVNNLKRILEEKGHTVHVEPNLQGESAVSKPDLVAIRQNHAFVIDAQIVTDGLSLDQAHLPKVERYKRPDVITAVRRDFNVSGAVEVLSATLNWRGIWSNQSVKGLITNNLLTTSDSNVISARVVIGGLYCFRQFMYLAGYSRNWT

SEQ ID NO: 32 - protein, 1149 aa, Trichinella nelsoni
MAAIRVNYPGPFTCQKCTFTETVFARFVTHCTHHALNVNLACSICGKDFTSINAVASHFPHCKKGTKRNETPIDAPTNTEMHVSTHNTHICTVCSRAFNSFAGLRLHEKRAHPATFAASSQKPTKHQWTIDHLREAKEVEDQLTDSNSCSAKSFAEALSSKWSEAISVDMAKYLRKKLRRVDINFNAHNRGTTDGDTSGLLPEVVGKSISLEGVGGKNRAALIGEEIHGVGVLSMRKTSGFRVEIVGQTTPSPNKSSNALSPQHRDRDPGRDLRHHLEDSLTSCNSELEGLLNFLTNKILNSKPEDRNKYVDDVISIVTEFVCKPNGHQPPPAPKKRTKEEPKNRRQKIRSKYAKMQSLFKRDPKRIAAHLIKNQPLCNVSCPIDAAESALRQRLSQRPSVDAAPFTSKCPPNSKNILDPISPEEVTLHLQRMKIHTSAGPDGIQVSHLRSCDPVCLAKAFNLFLLARHIPQQLKDCRTTLIPKIDHPRPDAEDYRPITVASSLYRLFSKIVTRRLEDSLSLHPRQKAFRSGTDGAFDNTSTLMTIIRNAHKRGRELNIVSIDLAKAFDTINHTSIDRALRMQGLDVDSRALIAQMVTGSSTIIKGDGGAFSNRIEINQGVRQGDPISPLLFNSVMDELIERLEKSKVGFKFMGEEITTLAFADDVTLISRSHRGMAKLLSITLDFLNERGLSLNVNKCKGIRLVRTPKTKSLVQDTSKAFRVPNIGEEKQYIPMVPSGNVIKFLGIQITLNGKPHFELAPLEGTLERIRKAPLKPAQKLATVRDYLIPSLEYKLGVPGISMKLLESVDAAIRLTVKRFLHLQITGMNSMFLTMPIKEGGLGLRPLTTQRIARVAVGTNSMMTSMDNVSRVVANTATLRKPLLSALEHFAVPAATKGAIREGKQNLLREEIAQLSETYQGSCLPSFKKGSLVNSWLRGTCGMRSRDYITGLKLRFGVIETRSQKWRGRTPQNPDALLCRHCGHLSGYRETAAHISQKCPTTHATIIQRHNKIVNLVADRAKREGFAVHVEPAIKSGGNVFKPDLVLVKDGAAHIVDVAVPWEKGTSMHEKHQKKTNEYSPTVEEVRAQFDAETCTVGAIIIGARSSWCPSNNRSLKACGLHLPKKFKRLLCRVALEGTCKIFQNFFTLT

SEQ ID NO: 33 - protein, 754 aa, Trichuris suis
MVKSLPGKGLELLFNLWLYLGDVPSRLKECRTVLVPKRYPPQGPGDYRPITIASTLYRVFTKILANRLSQCVELNRRQNGFMKGINGCGENTFILSTALESSRRHARELNLASLDLQKAFDTVSHASIRRALCRQNVPTKGIQLLMNLLSNSYTRLDHANGMSAPIPMCRGVKQGDPLSPLLFNLVMDELLDELEGAGGGFTFSPSTQVNCLAYADDILLLSDSRAGLQSNLLRCSRFLSARSLRLNIQKCSTLRMYKVPRIRSICATRDPMFYLDPTDESTLLPAFTGAEFLHYLGVDFNPYGRRRDQVAGALVLLARVRRAPLKPQQKIELIRNHLLPRLLYSLTVGNPLANTGRTIDKKIRQCVKEILHLPASTMCDDFFYVPRSRGGLGFLNLQEATDLSVLRLMVKMRTNDDDVARTSAEQWFNQRRFAKLAARRGLPTANLGALHKVKEEIAKKHQERFQRSYQGSGHAEFHDKRSNAWMGGEQMTGRGYINAIKVRASLVPTRVQTLRGRADPGDHRTLCRRCGDVSRAPESLAHISQTCAFCHGLIIRRHNAIVQKLAQLAQTQGFQCTTEPIIRINDQTHKPDLVLAKNSSCWTIDVSIPWESRDPLDRRHMQKCQKYRCLAEPVKKLTNSTEFSTGAIVIGARGAWCERNDDTLSRAGLSITDRMKQLLCLITLEKTCQLISWFMRSTDRLALRQPTRHRSSAQRTEARIPRSVDQAAFGSPARHHVAASPRHAPENRTVPAAH

SEQ ID NO: 34 - protein, 2419 aa, Tribolium castaneum
MENFIIANNMCIFNEPNNPPTFETTNGASYIDLTIGSEFLLNKIQTWKTVDINTSDHRAITFEFNDNHNQIFPEVNASMDQKICNFNIKKAAPLLEQLSTDLINKYSILISQNKIDQCLEKFYFELNKIISSCSRVKKTFKNRPTFWNEQIEALRRQYLKAKKDLYKNKNPDLKEALYISMSQVKQKFKDRIKLDKEKSWENFVKEDLAPNPWGVVYRVAAEKFKKTNLLGVFENDGETSLNPSDAAKRLLHSLLPDDNEENETLSQKITRQDFNTIEMTYRYNIDEVTNTELEIIIKNLKKKAPGLDKIDGNLTKIMHPSLSNFLLHIYNSCLRASYFPKCWKMGNLVVIPKDSGGDPSDIKNYRPITLLNDLGKIFEKLIRTRLFKSTDVFHADNQYGFCVGKSSTDALLFFKNQLQAYNQKYKYTAAVFFDISGAFDNVWYPSIIKSLRQKGVSPHLIRIMKSYVSDRNVIYSYRGIVNRKNCTKGCPQGSVLGPTLWNTILDEFLRKKIAPNTETIAYADDIVVITGANTRNEFRSTIQTIVTAVCQFAGNQKLQVSSSKTKIMMFNSPKRVHNRDLAIKINNSTIQIVTEHKYLGILFDSKFNFQKHINNVCSKARTIMMALRRKIKLRWNISVADSISAIYNHAIIPIVTYGSEVWADRLNISKIKSKLTSLSGLASRCIAGCYASVSNDAAHVLAGVPPLDLEAARINCCKLLKKDQNCNLLGFEIEKSDFDTYKHAREYVAILVEDLWQERWDSSTKGRTTYRFRPIVQSGLRYSHSFAATQILTGHGNFMSHLQRVGKSETDECAECGVRDDPIHRLLVCPLFDVPRRDIYRSVNSPFLSLNWIIHLKSELLEPFTALPQSLFIARTSRIAPLRSDYIEHRESESGSENCFVLVQTVFQGKSRIEQHLDLDADQLISEIQKQQDLPESLPKNFVKTAFKVGNKDGKANQWVVELHPVARNHFIKSGSRLFINWKSLHIRDYLRVTRCFKCQKFGHVSKFCNSEKQCGYCASTDHESVTCKLKNEENKHKCIAAVFGSSPRTLTIPGEGHVEASRRFVPISAAGLQGEEPLVDRIMIGSEDRGVSGLARKRVAADVPGLCEVKRCSVSAVNVESEFGPVPRPPAEPSCCEAPGAPVRARAMGLTTLSGTKTSNSGAQGPSTSAPMQNMAGGFVCDCGRSYALKTSLARHKKECGKNNTECRWCGTRFNTLAGTRQHERKAHFVQYQSDLAKALPQPESELMEKIAIVEARSSNGIFYKEMMASTGLTHQQVRSRREKPEYKGFLERARRSLAQTNIRAGSISPASTIAGSLESASPKAGCSSSASPGPTTRSRAPTKGVPLRSSNSARIVVEAQVHTRAPPNTGETEVALRESRRTVPRLGPNPSRPCGISPLMAIAIDEDSVLGGLRVQAEPSPTAVHSVETFPGTSSMTPMETDRVHNKSGIDPILEHNGTRQVRREESSTREDPVEQWSPNYPKTPVTMPNITTTADASCTSYNRTPQTLPGNRRRRSRSLPPVQRKSASDDLESVDSLGPWAVFLQDQVDAGSLSGNDSLADLVRVALTKSDRGVLNDAVNRYLAQRAESLRIRKRGSKGKRKSKTGRHYGQTTSGSGQRAALFKKHQDLFLKNRRGLAETILSGKEDFGPRPEPPVTSVEEFYGGIFESPSPPDNEPLEVRATGVEDPPTYITMDEIKAARAGWQISAPGSDQIPVAAVKTMSELELAILFNIILFRNVQPSAWGVLRTTLVPKDGDLRNPANWRPITISSAMQRLLHRVLAARLSKLVSLSSSQRGFTEIDGTLANALILHEYLQYRRQTGRTYQVVSLDVRKAFDTVSHCSVSRALGRFGIPSVIREYILATFGAQTTIKCGTVTTRPIRMLRGVRQGDPLSPVLFNLVMDELLEKVNEKYEGGSLQSGERCAIMAFADDLILIADRDQDVPAMLDDVSTFLERRGMSVNPAKCRALIAGAVSGRSVVRTGSSYKIHNTPIPNVDALDAFKYLGLEFGHKGVERPTIHNLSVWLNNLRRAPLKPDQKCLFIRQYVIPRLLYGMQNPQVTSKVLREADRLIRRHLKTYYHLNVHTPDSLIHASVRDGGLGIMELRKAIPRIFLGRLVKLLNKNNDSVLSSVLQSDRVRTLMGKLSTMAGEVPESTFWRNRIASGPLSKGLEQAAEDSASRLWISEKPSGWSGRDHVRAVQLRTGNLPTKAIPSVPVGQRRCRHGCACDESISHVLQMCPLTHADRIRRHDEVVKKVARHCTSRGWTVEVEPHIRSRCGRLFKPDLAVHQPGGAIVIADVQISWDSESLTVPYERKRAKYDVPQFHQAAQHAWPGKALTFAPVIVGARGIWPRINNDRSAALQIPPVVRRACVNSVVKWGSSIHATFMSETTAKGTGLEKLAGKEDPVELDSSLAL

SEQ ID NO: 35 - protein, 405 aa, Ixodes scapularis
MACSPHQFHPQKEPAALPSDFRPITVGPVLQRLFHKILAKRVMAAAPLDFRQRAFQPVDGCAENILLLSTVLDEARCRLRPLHLASVDLAKAFDRVTTEAILRGALRAGFDDAFLAYLRELYATSYTTLQYGGEELVVQPTTGVRQGDPLSPVLFNMVLDEFLSSVDPRVAFRSGDFTVDAMAFADDLVVCASTPQGLQQRLNDLAAFLSPRGLNINVAKSFTLSLQPSAREKKCKIVTTNRFHINGEPLPVSGVASVWRYLGVSFTPDGTRSNGVEMELEELLERVKKAPLKPQQRLLVLRTYLLPRLFHRLILGPWSVGLLKKLDTKVRAALRSWLALPHDVPLGYFHAPVGEGGLGVVSLRASIPSMRLRRIEGLRFSDHPGCAEALRCPLLLEGFPFRNKN

SEQ ID NO: 36 - protein, 486 aa, Eptatretus burgeri
ALAFADDLVLCARTSSGLRRSMDAVQTRLSAAGLVLNVEKSATLAITIDAKAKRYVVDTSEVFYLGQQNLGVLDAASQLKYLGIQFLPRGAAPSDGSALEKGLRNLRRAPIKPQQRMFMLRDHLIPQLQHGLVLGAARRGTLRKLDVQMRHHTRLWLRLPKDTPVAYFHARSADGGLGLPQFSVTIPILRERRMRGLEQSDSPYVRAVIRTKLGDVVRSRNTYNLHYGGERPRSIKQADVITAKLLHQAVDGRGLLEASRVPEPNDWVLGRSRLQSGRAFIDSVKVRGNLLPTGSRSSRGRRGQGSEGWCDAGCRAKESLNHISQACIRTHGGTVQRHDAVSRFACGRLRQRGFVVIEEPRIPTPAGIRKPDIIAEKNGKPVILDTQIKSDTLKLSDEHVRKRNYYDTPEVLDWVRNKFESENVPLVSTITLSWRGVWAPESATLLRELGLTKTDLRLISVMVVEKTALMFRWFKRSALTRNAPRQ

SEQ ID NO: 37 - protein, 519 aa, Triops cancriformis
PIIFNLVINGAIRRLPDEFGFEVSPKIFLNCLAYADDLILVATTRIGLKRLIIIVGEYLQRRGLKLSAEKSIGLSITACGKEGLTYVSSANKIDFQGVEIKNMCVLDTWQYLGIQFSHIGCTDRITPEVSDLLFKLQKAPLKVQQKLYALRHYLIPRLLHGLILSRVLITELKSIDNLIRKYVRSLLHLPKDTPLGYLYASTKDGGLGIPCLRYLILKCRLARILRMRSSNDAVVREIANSEFLLHETQRLRDSLSIDGSVLDTNELIRKYWAKRLYTSYDGKSLAYSEFFPYGNSWVREDHMNQRAHVFCDCIKLRINALPTRARTSRGRTESKDSSCRAGCKFSSGIPMRETVNHITGVCQRTHDARVRRHDSIVDFLVSIWKTKSTNEVYKEPNYRTPLGLRKPDIVVKTPNEVWIADVQVLADNANLEKEYSIKTNKYASDAGLIQGLKKQFPNINLFSFFAVTINNRGLISRSSVNELRKRGVNSRDMLTIILRAMEGSLMIWRIFNQTTSSAR

SEQ ID NO: 38 - protein, 1308 aa, Trichinella murrelli
MGKRSTDNVNKLEGPLSNNEAPVNNRMVTRSTIKRATVVDSRSAPPLLVRPPVESPEFKLVCATIDNRRQKSTASSAPLNNGGICQPLSEAPDDNAAVVSNSCAVSEIKEMPPARINMRLRSRKACGNIPEPPRLPRTSQTASESHDGSQPCPGSSTAITSFPRASDNHPVSTNTQGTHVCSVCSRVFNSFPGLRLHEKRAHPATFAASSQKSVKHLWTTDHLREVKEVEEILAANNSRSVKALAEALSRKWSEDISMDMAKYLRKKLRAVDLNSAQPTNTALTDGVNSPREGPENLTEEGESLNNGSQVIGTEIMGPERFPECDSFQTHSANADLSNPCPQHPDGLLSEQGLDRDQGGVLRKHLEDGLASCNSELEGLLNFIVSKVLNSGIEDRNKHVDAAISVLTEFLCESKSHQPPPPRKKRTREEPKNRRQKIRSKYAQMQTLFKRDPKRVAAHLIRNQPLCNVSCPIDAAESALRQRLSQRPGVDAAPITSKCPQNSKNILDPIFPEEVTLHLQKMKIHTSAGPDGIKVSHLRSCDPVCLAKAFNLFLLARHIPQQLKDCRTTLIPKTDDPRPDAEDYRPITVASCLYRLFSKIVTRRLEDSLSLHPRQKAFRSGTDGAFDNTSTLMTVIREAHNCGKELNIVSIDLAKAFDTVNHTSITRALRMHGLDDESRTLITEMVTGSSTIIKGDGGALSNRIEINQGVRQGDPISPLLFNAVMDELVERLERTGEGFKLKGVEVTTLAFADDVTLISRSHRGMEKLLSITLDFLNERGLQLNINKCKGIRLVRTPKTKSLVEDTSKPFRVPSFGEENQHIPMVLPGDLIKFLGIDITLNGKPHFDLAPLEDTLERIRKAPLKPAQKLATVRDYLIPSLEYRLGVPGISRKLLESVDGAIRLTVKRFLHLPLTGMNSMFLSMPVKEGGLGLRSLSTQHIARLAVGTNSMSISTDTVSRVVADTTTLRKPLLSALEHFAVPTATKSAIREGKRNLLRAEIAQLSETYQGSCLPSFKHGSLVNTWLRGTSGMRSRDYITGLKLRFGVIETRSQKWRGRTPQNPDALLCRHCGHSSGNRETAAHVSQKCLVTHALIVQRHNKIVRLVGDRAKDEGFAVHVETAVKSGEEVYKPDLILIKADTAHIIDVAVPWEKGTNMHEKHERKTNKYAQLVDDVKALFGVQNCTVGALVIGARSSWCTSNDGSLKACGLHLPKKTDGEDLTTEADDSDAEPWQKPEHSPPHAKENTEDRNTEEQSEPYTTPQTLRTSENPEIQRRRRLHRTTTRRDCARRTDHNWTPERGTTHPQKQGP

SEQ ID NO: 39 - protein, 1327 aa, Trichinella papuae
MGKPSRPAQETPSTAAGSDGQARSGLRRRNHAEVTYPGPFTCTVCSLTECVYSRFKNHCMTHHLHLELSCSVCRKVFPTINAVACHYPHCAKTPRNPNISQNIPETTQVGRTVASSINNKGISENKEPPQNNRVVTRSQVKRAAVGAVTRSRSSLCNGAPAVNAAAGIVRSQVNVVFPDCATLNNNSRQRLMVAPAPPNNGELCSPLSGKVTDGGNVIVRRSARLASNCEAGLHNNGADASSVANVPVIKEVPPARTYRRNRPASANTNITETPRQPPTSMTVPECRRRTREQPQRTTASEATQPAAPTVADNAFPCGECGRVFSTFAGMRLHLKRAHPSSFSSLQPPVKVPRWSALESDTLRELEDALRRNGELSNEKLASLMTDRFERVFTIDMVKGHRRKFRETPRTEGENSRPSTPRESTPAPTAQTSPSTMPVNNITRDNPETAEDINKKLKQHLLHCTTTHNTEVEAEINDIIRNHIIKGNNKNYVTRIVKYLIGAMRPEEERGPKKGRKKKKPEPSVPLNSKQRKRMAYRKVQQAYHKDPKRVVAHLFHSQPLENVSCPVESGEKALQARLGKRPPADRAPFLPKRAPLKNHLLSPISAKEVSEHLKQMNLASASGPDGVKVSHLRDIGPQCLSKIFNTFLLERHIPQVLKDCRTTLIPKVDNPRPDAEDFRPITIGSCIYRLFSKIVTSRLSQLTPLNPRQKAFRSGTDGAFDNITTVASLLKLARKTGKEINLACIDLAKAFDTVNHTSITRALHRHGVDSASIELVESMVGEATTVIINSDGTRSNVIKFNRGVRQGDPISPLLFNLVLDELIDNLDQARCGFSITKEIQVSCVAFADDITLVSGSREGMNNLLTITREFLGERGLGINHSKCKGIRFTKVPKSKSLIIDTNPNCFLIRNQQGTPEPIPMAKPGEPLKTLGINLTLEGNPTFNYPELTRILNTIKHAPLKPHQKVQIIRDHLIPLLQYKLGVPTFYRATLNNIDKSIRLTVKEILHLPTTGLHNSYLYLPLKEGGLGLKRLATQYASRVGLGLSNMATSDDAVSRAVAGLHLSLMDKAKNCLGLSEISKEAIKKAKEKLVQAEIRTLLQCHLGRSHSSFTNDTISNSWMRYPTFLSARNYIMGIKLRAGIIETRAQKWRGRSPPHPTMLLCRHCGARSRTRETDIHVSQKCLHNKKLILRRHNCVVSTLGRRATQQGFAVYYEPCIKHGETVLKPDLVIIKGDTATIIDVAVPWEQGTNLREHNSRKISKYQCLEREAAKYFNVKTVKTGSLVVGARGKWSAGNDSTLKSCGLHCSKRLKKLLCTIALEGTCAVFKH

SEQ ID NO: 40 - protein, 1365 aa, Trichinella britovi
MVTRSTIKRATVVDSRSAPPLLDRPPVERPEIKLVCATIDNRRQKSTAASAPLNIVGICQPLFEAPDDNAAVVSNNCAVSEIKEMPPARINMRLRSRKACGNILEPPRPPRTSQSASESHDGSQPCPGSSAASTNSPRASISQPASTNAQGTHVCSVCSRAFNSFPGLRLHEKRAHPATFAASSQKSVKHLWTIDHLREVKEVEEMLAANNSRSVKALAEALSRKWSEDISMDMAKYLRKKLRAVDLNSAQPTNTALTDGVNSPREGPENTTEEGESLNNGSQVVGTEIMGPERLPECDSLQTHSANADLSNPCPQHPDGLLSEQGLDRDQWGVLRKHLEDGLASCNSELEGLLNFIINKILNSGSEDRNKLVDAAISVLIEFLGEPKSHQPPPPRKKRTREEPKNRRQKIRSKYAQMQTLFKRDPKRVAAHLIKNQPLCNVSCPIDAAESALRQRLSQRPGVDAAPFTSKCPQNSKNILDPIFPEEVTLHLQNMKLQTSAGPDGIKVSHLRSCDPVCLAKAFNLFLLARHIPQQLKDCRTSLIPKTDDPRPDAEDYRPITVASCLYRLFSKIVTRRLEDSLSLHPRQKAFRSGTDGAFDNTSTLMTVIREAHSCGKELNIVSIDLAKAFDTVNHTSITRALRMHGLDDESRTLITEMVTGSSTIIKGDGGALSNRIEINQGVRQGDPISPLLFNAVMDELVERLEQTGEGFKLKGVEVTTLAFADDVTLISRSHRGMEKLLSTTLDFLNERGLKLNISKCKGIRLVRTPKTKSLVEDTSKPFRVPSFGEENQHIPMVLPGDLIKFLGIDITLNGKPHFDLAPLEATLERIRKAPLKPAQKLATVRDYLIPSLEYRLGVPGISRKLLESVDGAIRLTVKRFLHLPLTGMNSMFLSMPVKEGGLGLRSLSTQHIARLAVGTNSMSISTDTVSRVVADTTTLRKPLLSALEHFAVPTATKSAIREGKRNLLRAEIAQLSETYQGSCLPSFKHGSLVNSWLRGTSGMRSRDYITGLKLRFGVIETRSQKWRGRTPQNPDALLCRHCGHSSGNRETAAHVSQKCLVTHALIVQRHNKIMRLVGDRAKDEGFAVHVETAIKSGEEVYKPDLILIKDDTAHILDVAVPWEKGTNMHEKHERKTNKYAQLVGDVKALFGVQNCTVGALVIGARSSWCPSNDGSLKACGLHLPKKPDGEDLKTEDNHPCAESRQRPKHSPPLEEENTEERNTAEQTEPCTTPQTLRTTENPDIRRRTRLNRTTTRRDCARRTGHNWTPYIKTDLCRNIGLNLSLIKSHWCASQIRLTAAGTFLRESPANSATSQMPRHLISDAYEWINKIPSVPIYYLAKPQPRERAWQNQRGKKTLLSLTLV

SEQ ID NO: 41 - protein, 1144 aa, Schistosoma mansoni
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLCQHISTILTRRTAEAVKRRLLHLQWSRSPTAITTSSNNHTITDIPNTEARYIFPVDLDEHPPLSDATTPNASTHPLPELLVILTPLPSPTRLQNISESQTSHESNKNSMHTPPTYACDPDETLGATPSSTIPSCFHSYQDPLAEQRGKLLRASASLLQSSCTRIRSSSLLAFLQNESTLMDEEHVSTFLNSHAEFVFPRTWTPSRPKHPSHAPANVSRKKRRKIEYAHIQRLFHHRPKDASNTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHTGASFALLDISRAFDTVSHDSIIRAAKRYGAPELLCRYLNNYYRRSTSCVNRTELHPTCGVKQGDPLSPLLFIMVLDEVLEGLDPMTHLTVDGESLNYIAYADDLVVFAPNAELLQRKLDRISILLHEAGWSVNPEKSRTLDLISGGHSKITALSQTEFTIAGMRIPPLSAADTFDYLGIKFNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVVLTFRGILDRASSQSLRRLCFSSRDLGDLCLSAIQGSIKIYNTYMRGT

SEQ ID NO: 42 - protein, 1025 aa, Nasonia vitripennis
NQIKKSNTSTGARIPKAMTNPADNFAGGQWKPPGRRSARTSATGMFVCEHCLRAFTTNTGRGLHIKRAHEEQANEAITTERSRARWTNEEMEAVQAEIDCEGRTAINQEILRIIPYQRTIDAIKCLRKQQKYKTIRERVANRRAENRARETELTRLETADEDPASQEQDNPNMSLKNWLKEVIESDDDRLCADLRTAIEMALAGQSPLDVCTVGCYQYTMTNLPLVPVRLGGPIYWCNAQSRSNPGETQRRQTIKESNNSWKKNMSKAAHIVLDGDTDACPAGLEGTEASGAIMRAGCPTTRHLRSRMQGEIKNLWRPISNDEIKEVEACKRTAAGPDGMTTTAWNSIDECIKSLFNMIMYHGQCPRRYLDSRTVLIPKEPGTMDPACFRPLSIASVALRHFHRILANRIGEHGLLDTRQRAFIVADGVAENTSLLSAMIKEARMKIKGLYIAILDVKKAFDSVEHRSILDALRRKKLPLEMRNYIMWVYRNSKTRLEVVKTKGRWIRPARGVRQGDPLSPLLFNCVMDAVLRRLPENTGFLMGAEKIGALVFADDLVLLAETREGLQASLSRIEAGLQEQGLEMMPRKCHTLALVPSGKEKKIKVETHKPFTVGNQEITQLGHADQWKYLGVVYNSYGPIQVKINIAGDLQRVTAAPLKPQQRMAILGMFLIPRFIHKLVLGRTSNADVRKGDKIIRKTVRGWLRLPHDTPIGYFHAPIKEGGLGIPAFESRIPELLKSRIEALGASNMQTARSLLGGDWVAERKKWINTQKIKNSEWAQKLHLTTDGKDLRDTRKAEASYSWIRDIHVAIPASVWIKYHHTRINALPTLMRMSRGRRTNGNALCRAGCGLPETLYHVVQQCPRTHGGRVLRHDKIAEQVAIFMQEKGWLVLREAHIRTSVGLRKPDIIARKGQDCKIIDCQIVTTGNDIRIQHERKIQYYASNWELRRSAATMIGHQGQVSVEAITISWKGVWEPRSYCLLRDCGIPKVKIKGLTTRVLLGAYLNFNTFSKATYRTERRRTAN

SEQ ID NO: 43 - protein, 869 aa, Bradysia coprophila
VSVPPTSYRDRIMNALEESMIDVDAIRGSSARELVEIGKVALLNQPMDEGRIMSWLSDRFPDTQKPKGPIYSKTTIYHGTNKQKRKQRYALVQSLYKKDISAAARVVLDENDKIATKIPPVRHMFDYWKDVFATGGGSAATNINRAPPAPHMETLWDPVSLIEIKSARASNEKGAGPDGVTPRSWNALDDRYKRLLYNIFVFYGRVPSPIKGSRTVFTPKIEGGPDPGVFRPLSICSVILREFNKILARRFVSCYTYDERQTAYLPIDGVCINVSMLTAIIAEAKRLRKELHIAILDLVKAFNSVYHSALIDAITEAGCPPGVVDYIADMYNNVITEMQFEGKCELASILAGVYQGDPLSGPLFTLAYEKALRALNNEGRFDIADVRVNASAYSDDGLLLAMTVIGLQHNLDKFGETLAKIGLRINSRKSKTVSLVPSGREKKMKIVSNRRLLLKASELKPLTISDLWKYLGVVYTTSGPEVAKVSMDDDLSKLTKGPLKPQQRIHLLKTFVIPKHLNRLVLSRTTATGLCKMDLLIRKYVRRWLRLPGDVPVAFLYAPVKAGGKGIPCLKQWIPLMRFLRLNKAKRTGGDRIAAVLNCQLYASISHSCKTGPVSVGLWRSTNTGGLSAYWRRILIGMVDGKDLKSAQNHSSATSFNSIRMNDISGEDYIHYNQLRTNSIPTRKRTARGRPNKPTACRAGCDKLKRLQHDIQGCIRSQGGLVQRHDRVVDLLFDECETKGYAAEKVVHLRTSEELWKPDLVLKKNGRVVVVDAQVVQCGRLESDHRVKVSKYRDDPELADVIREKYAVQEVTFEACTLSYKGIWSKNSVEGLQKLGISNYCLFKIVTSVLRGSWLNWVRFNNVTTVVHW

SEQ ID NO: 44 - protein, 1316 aa, Tribolium castaneum
MVPLLLVLDLEPTVLTTPLDLRERTMLMDMDSEDEAGEHGPPADNAHLTSGEPIEIILMLPFQSRSCICLNAGKGNFRATADGDLESWCGSDVHHLRKTSWRKPQTGMKSRSFRRIGDCAAGSSRRGVRLTGKAGREGRFAASPHLSPRYLAGSVSGNVPSVPPNPGLGAGAPAFAAVPNADGGPAQNPCPYCARSFTTANGRGLHIRRAHPDEANNAIDIERIHARWSHEETAMMARLEAGAIQRGGVRFMNQFLVPRMPGRTLEAVKSKRRDATDKALVQRFLQGDRLCNIARRACDGGDVSGQLLGWLRDVFPVKRVSTRGDQSNLDVDGALVSRHTARTREYARVQELYRKDPKACLARIFGDRREGANRAPNRDPAFIDFWRGVFSEASAEVEGCAEEVSDHGGGKVSGPEWCSAGARRNSGFRVEQLPPEAAALLFNVLLLGRCLPAELTRTRTVFIPKTDAPRTPADYRPISIASVVARHFHRVLSAHVQRIPDLFTKYQRGFLSGVDGIADNLSVFDTMLTMSRRCCKHLHLAALDVSKAFDTVSHFAIVRACRETHSLLSSLTWSWTGLLKRLSTDVGFRLTDATKVTALAFADDVVLCATTARGLQTNLDVLEAELRLAGLLLNPNKCQALSLVASGRDHKVKLVTKPTFTVGQNTILKGSGMCGCGSEGVAAGLKRNTCAPLKPQQRMHLLRVFFLPKFYHAWTFGRLNAGVLRRLNVVVRTSVRTWLRLPHDIPVGKFHAPTKSGGLGIPQLSRLIPFLRLKRFDRLGRSAVDYVRECAFTDIADQKIRWCRERLSGIVDQVAGGRDALDAYWTAQLHQSVDGRALRESASVASSTQWLRCSTRAIPASDWLHYTAVHIGALPSRVRTSRGRRGGQDVSCRGGCLLDETPAHCIQVCHRTHGGRMLRHDAIAKRISADLMELGWIVTREVSFRTTAGVFRPDMVAVKEGVTVILDVQIVSPAPTLDEAHRRKVAKYRDRADLARYLAEAAVARGRAPPANIRFASATISWRNVWSAESVGSLRELRLSARHFNRYTTMSFCGSWRNWVRFNASTASGMGRGRGDASPRRHENQHDNDSLADLVRVALTKSDRGVLNDAVNRYLAQRAESLRIRKRGSKGKRKSKTGRRYGQTTSGSGQRAALFKKHQDLFLKNRRGLAETILSGKEDFGPRPEPPVTSVEESYGGIFESPSSPDNKPFEVRATGVEDPPTYITMDEIKAARAGWQISAPGSDQIPVAAVKTMSELELAILFNIILFRNVQPSAWPSQGAVRPCRWWEGLSTCNESAGNAGGSHGRDSWQGHPCQ

SEQ ID NO: 45 - protein, 1057 aa, Drosophila melanogaster
FERKNFSDGLVPQRKFIHIGTTSTNNEPRIPLHNLMTTRPSVDIFPEDQYEPNAAATLSRVPCTVCGRSFNSKRGLGVHMRSRHPDELDEERRRVDIKARWSDEEKWMMARKEVELTANGCKHINKQLAVYFANRSVEAIKKLRQRGDYKEKIEQIRGQSALAPEVANLTIRRRPSRSEQDHQVTTSETTPITPFEQSNREILRTLRGYSPVECHSKWRAQELQTIIDRAHLEGKETTLQCLSLYLLGIFPAQGVRHTLTRPPRRPRNRRESRRQQYAVVQRNWDKHKGRCIKSLLNGTDESVMPSQEIMVPYWREVMTQPSPSSCSGEVIQMDHSLERVWSAITEQDLRASRVSLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRTLPSEIGAKVGNAITNAAAFADDLVLFAETRMGLQVLLDKTLDFLSIVGLKLNADKCFTVGIKGQPKQKCTVLEAQSFYVGSSEIPSLKRTDEWKYLGINFTATGRVRCNPAEDIGPKLQRLTKAPLKPQQRLFALRTVLIPQLYHKLALGSVAIGVLRKTDKLIRYYVRRWLNLPLDVPIAFVHAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTTRGRHELERQCRAGCDAPETTNHIMQKCYRSHGRRVARHNCVVNRIKRGLEERGCVVIVEPSLQCESGLNKPDLVALRQNHIDVIDTQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 46 - protein, 1080 aa, Trichinella murrelli
MSNRLANTAAAGGVPEKNSGTLDIPGQPSSSGEKRAISYPGPFGCNSCSFTSTTWLSMELHFKSVHNTCEFVFLCSKCEKSWPSINSVASHYPRCKGSVKAAVVPSSLTNTCTTCGSSFGTFSGLQLHRKRAHPDVFAASCSKKTKARWSNDEFTLLARLEAGLDPACKNINQVLAERLMGYNITRGVEMIKGQRRKDQYKALVRQLRSNSETQQCVGLAGSMDLNVPVNDTTSSVASEVTITYPEYGAVMSCDLIKEATGMAMVDVNELQSNIRKLFSSGRKLPMKLRGAREAVQKKMANPRVAKFKRFQRLFRSNRRKLANHIFDKASLEQFGGSIDEASDHLERFLSRPRLESDSYSVISGDKSIGVAHPILAEEVELELKASRPTAVGPDGIGLEDIKKLNSYDLASLFNLWLKAGDLPESVKASRTIFLPKSDGTTDISNCRPITIASALYRLFSKIITRRLAARLELNVRQKAFRPEMNGVFENSAILYALIKDAKVRSKEICITTLDLAKAFDTVPHSRILRALRKNNVDPESVDLISKMLTGTTYAEIKGLQGKPITIRNGVRQGDPLSPLLFSLFIDEIIGRLQACGPAYDFHGEKICILAFADDLTLVADNAAGMKILLKAACDFLEESGMSLNAEKCRTLCISRSPRSRKTFVNPAAKFNISDWKTGVSSEIPSLCATDTFRFLGHTFDGEGKIHIDTEEIRSMLKSVKSAPLKPEQKVALIRSHLLPRLQFLFSTAEVDSRKAWLIDSIIRGCVKEILHSVKAGMCTDIFYIPSRDGGMGLTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENLRGRLGMKECRFCKSAIETLAHICQKCPANHGLVIQRHNAVVTFLGEVARKEGYQVMIEPKVSTPVGALKPDLLLIKADTAFIVDVGIAWEGGRPLKLVNKMKCDKYKIAIPAILETFHVGHAETYGVILGSRGCWLKSNDKALASIGLNITRKMKEHLSWLTFENTIRIYNSFMKN

SEQ ID NO: 47 - protein, 1168 aa, Pediculus humanus corporis
MRTRQSKNQNKSCSTVDLRQLDENVNFTASDPGHSNDVSHRSPVQETTRSHRIRWTQEDLQELMWCYFYSQKFGSGSESDTFKIWRGRNPNSRKDMTSKKLAAQRRYIIKKIENDKLEEIKKNVDSSCSNVIRDNAPIITKLNESNNNNRYETDTDEQLLTDAEMKSIEERLIEEIKKVKMCPLINREPLRKIYKNKKATEVLHLIDNTLINVLEKVVDINLTTINEIIYAAGVVATDIILGPRKEARHKGIETKKSTSPIWIQRIEGKIKRIRSHISLVSEMKKNNNLKKRTIKKLDHLKRIYKLKTMEDIELTMETLKQKVLLYSQRIRRYKKREQFWRQNKLFESDPKKFYRTIREQNIQNGSSTLNVEKMADFWSNIWEKSHPLNKNSTWMNKEKEAHAWIASSTMSDIIMADLEICLKNTANWKSPGLDRVQNFWIKNFTSTHKYLLVSINKLIMGRQEMPEWITTGKTYLLPKKSGAMEPKDFRPITCLPTMYKIITAIIAEKIYGHLRKNNIFPPEQYGCRKGSYGCKEVLLINKLIMASAKQKRKNLSMAWIDYQKAFDSVPHEWIIEALKIYKVDPKITAFCEKSMKNWCTQLEVQKYSSRKIFIKRGIFQGDSLSPLLFCMSLIPLSRQLNIKDQGYQLVPGGRKITHMLYMDDLKLYAKNEEELNKMLRTVQTFSSDINMKFGLEKCARINIVRGKLKQKQNIEDSEEELIKELDPGSSYKYLGIEENFGIANKEIKPRLKKEYFKRLRLILQSELNGRNKITAVGTLAVPVIEYSFGLVDWTKEEITHLDRRTRKILTMNGALHPKADVDRLYVSRKDGGRGLRQIEAAHQNAIIGMGKYIESHREDPILAQVIHAEEKTTKKGVLKRAKQIVQENKENEIMEEGQLATYNSKAQSQKKLIGKWEQKKLHGQYLKRINAEDINKKSTHNWLRRGKLKIETEAFITAAQDQALRTHNYEKVILKVRQDDKCRICQSQSETIDHLISGCPILAKHEYLERHNKICQYLHWSICREYGMDGLPKEWYNHIPSPVTTVGPCTVLYDQQIHTDRTVPANKPDIILRHNGEKWCKLIEVSVPAEKNTTAKEADKRLKYRNLEIEITRMWGTKTETIPVIVGALGAMPHSIKGNLKKIMKNLKEETIQEIALCGTAHILRKIL

SEQ ID NO: 48 - protein, 1168 aa, Pediculus humanus corporis
MRTRQSKNQNKSCSTVDLRQLDENVNFTASDPGHSNDVSHRSPVQETTRSHRIRWTQEDLQELMWCYFYSQKFGSGSESDTFKIWRGRNPNSRKDMTSKKLAAQRRYIIKTQKIENDKLEEIKKNVDSSCSNVIRDNAQIITELNESNHKSKTDTDEQLLTDAEMKSIEERLIEEIKKVKMCPLINREPLRKIYKNKKATEVLHLIDNTLINVLEKVVDINLTTINEIIYAAGVVATDIILGPRKEARHKGMETKKSTSPIWIQRIEGKIERIRLHISLVSEMKKNNNLKKRTIKKLDHLKRIYKLKTMEDIELTMETLKQKVLLYSQRIRRYKKREQFWRQNKLFESDPKKFYRTIREQNIQNGFSTLNVEKMADFWSNIWEKSHPLNKNSTWMNKEKEAHAWIASSTMSDVRMADLETCLKNTANWKSPGLDRVQNFWIKNFTSTHKYLMVSINKLIMGRQEMPEWITTGKTYLLPKKSGATEPKDFRPITCLPTMYKIITAIIAEKIYGHLRKNNIFPPEQYGCRKGSYGCKEVLLINKLIMASAKQKRKNLSMAWIDYQKAFDSVPHEWIIEALKIYKVDPNITAFCEKSMKNWCTQLEVQKYSSRKIFIKRGIFQGDSLSPLLFCMSLIPLSRQLNIKDQGYELVPGGRKITHMLYMDDLKIYAKNEEELNKMLRTVQTFSSDINMKFGLEKCARINIVRGKLKQKQNIEDSEEELIKELDPGSSYKYLGIEENFGIANKEIKPRLKKEYFKRLRLILQSELNGRNKITAVGTLAVPVIEYSFGLVDWTKEEITHLDRRTRKILTMNGALHPKADVDRLYVSRKDGGRGLRQIEAAYQNAIIGMGKYIESHREDPILAQVIHAEEKTTKKGVLKRAKQIVQENKENEIMEEGQLATYNSKAQSQKKLIGKWEQKKLHGQYLKRINAEDINKKSTHNWLRRGKLKIETEAFITAAQDQALRTHNYEKVILKVRQDDKCRICQSQSETIDHLISGCPILAKHEYLERHNKICQYLHWSICREYGMDGLPKEWYNHIPSPVTTVGPCTVLYDQQIHTDRTVPANKPDIILRHNAEKWCKLIEVSVPAEKNTTAKEADKRLKYRNLEIEITRMWGTKTETIPVIVGALGAMPNSIKGNLKKIMKNLKEETIQDIALCGTAHILRKIL

SEQ ID NO: 49 - protein, 920 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQGGGVG

SEQ ID NO: 50 - protein, 854 aa, Artificial Sequence
  Description of Artificial Sequence: Synthetic polypeptide
MAHHHHHHVGTVGTGGGSGGASTALKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 51 - protein, 642 aa, Artificial Sequence
  Description of Artificial Sequence: Synthetic polypeptide
MAHHHHHHVGTVGTGGGSGGASTALKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQGGGVG

SEQ ID NO: 52 - protein, 1132 aa, Bombyx mori
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 53 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTSRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 54 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGSKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 55 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTSRAGSKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 56 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQSHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 57 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCYRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 58 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILQHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 59 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGQILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 60 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVSATSCTISWRGVWSLTSYKELRSIIGLREPTLQIVPILALRGSHMNWTRFNQMTSVMGGGVG

SEQ ID NO: 61 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKARAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 62 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRAAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 63 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVAELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 64 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKAAAEYARVAELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 65 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPAPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 66 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPAGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 67 - protein, 1132 aa, Artificial Sequence
  Description of Artificial Sequence: Synthetic polypeptide
MAHHHHHHVGTVGTGGGSGGASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPAPAGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 68 - DNA, 19 bp, Artificial Sequence
  Description of Artificial Sequence: Synthetic primer
tgatgacgaggcatttggc

SEQ ID NO: 69 - protein, 25 aa, Artificial Sequence
  Description of Artificial Sequence: Synthetic peptide
MAHHHHHHVGTVGTGGGSGGASTAL

SEQ ID NO: 70 - protein, 6 aa, Artificial Sequence
  Description of Artificial Sequence: Synthetic 6xHis tag
HHHHHH

SEQ ID NO: 71 - protein, 69 aa, Artificial Sequence
  Description of Artificial Sequence: Synthetic polypeptide
MPSVQEVEKLLHVLDRNGDGKVSAEELKAFADDSKCPLDSNKIKAFIKEHDKNKDGKLDLKELVSILSS

SEQ ID NO: 72 - DNA, 210 bp, Artificial Sequence
  Description of Artificial Sequence: Synthetic polynucleotide
atgccgtctgttcaggaagttgaaaaactgctgcacgttctggaccgtaacggtgacggtaaagtttctgcggaagaactgaaagcgttcgcggacgactctaaatgcccgctggactctaacaaaatcaaagcgttcatcaaagaacacgacaaaaacaaagacggtaaactggacctgaaagaactggtttctatcctgtcttcttag

SEQ ID NO: 73 - protein, 854 aa, Artificial Sequence
  Description of Artificial Sequence: Synthetic polypeptide
MAHHHHHHVGTVGTGGGSGGASTALKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPAIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 74 - RNA, 38 nt, Artificial Sequence
  Description of Artificial Sequence: Synthetic oligonucleotide
cagucagucagucagucagugccaaaugccucgucauc

SEQ ID NO: 75 - DNA, 45 bp, Artificial Sequence
  Description of Artificial Sequence: Synthetic primer
ctgcagtaatacgactcactataggatcctctagagtcgacctgc

SEQ ID NO: 76 - DNA, 21 bp, Artificial Sequence
  Description of Artificial Sequence: Synthetic primer
gccattcgccattcaggctgc

SEQ ID NO: 77 - DNA, 204 bp, Artificial Sequence
  Description of Artificial Sequence: Synthetic polynucleotide
acggccagtgaattgtaatacgactcactatagggcgaattgggtaccgcctcgaggtcgacggtatcgataagcttgatatcgaattcctgcagcggatccactagttctagagcggccgccaccgcggtggagctccagcttttgttccctttagtgagggttaatttcgagcttggcgtaatcatggtcatagctgtttcc

SEQ ID NO: 78 - DNA, 24 bp, Artificial Sequence
  Description of Artificial Sequence: Synthetic primer
acggccagtgaattgtaatacgac

SEQ ID NO: 79 - DNA, 19 bp, Artificial Sequence
  Description of Artificial Sequence: Synthetic primer
ggaaacagctatgaccatg

SEQ ID NO: 80 - DNA, 22 bp, Artificial Sequence
  Description of Artificial Sequence: Synthetic primer
cagggttattgtctcatgagcg

SEQ ID NO: 81 - DNA, 25 bp, Artificial Sequence
  Description of Artificial Sequence: Synthetic oligonucleotide
  Description of Combined DNA/RNA Molecule: Synthetic oligonucleotide
gttaataacgaaatgagcagccggg

SEQ ID NO: 82 - RNA, 196 nt, Artificial Sequence
  Description of Artificial Sequence: Synthetic polynucleotide
ggauccucuagagucgaccugcaggcaugcaagcuuggcacuggccgucguuuucaacgucgugacugggaaaacccuggcguuacccaacuuaaucgccuugcagcacaucccccuuucgccagcuggcguaauagcgaagaggcccgcaccgaucgcccuucccaacaguugcgcagccugaauggcgaauggc

SEQ ID NO: 83 - DNA, 24 bp, Artificial Sequence
  Description of Artificial Sequence: Synthetic primer
cagtcagtcagtcagtcagtgcca

SEQ ID NO: 84 - DNA, 22 bp, Artificial Sequence
  Description of Artificial Sequence: Synthetic primer
cacgacgttgtaaaacgacggc

SEQ ID NO: 85 - RNA, 600 nt, Artificial Sequence
  Description of Artificial Sequence: Synthetic polynucleotide
ggauccucuagagucgaccugcaggcaugcaagcuuggcacuggccgucguuuuacaacgucgugacugggaaaacccuggcguuacccaacuuaaucgccuugcagcacaucccccuuucgccagcuggcguaauagcgaagaggcccgcaccgaucgcccuucccaacaguugcgcagccugaauggcgaauggcgccugaugcgguauuuucuccuuacgcaucugugcgguauuucacaccgcauauggugcacucucaguacaaucugcucugaugccgcauaguuaagccagccccgacacccgccaacacccgcugacgcgcccugacgggcuugucugcucccggcauccgcuuacagacaagcugugaccgucuccgggagcugcaugugucagagguuuucaccgucaucaccgaaacgcgcgagacgaaagggccucgugauacgccuauuuuuauagguuaaugucaugauaauaaugguuucuuagacgucagguggcacuuuucggggaaaugugcgcggaaccccuauuuguuuauuuuucuaaauacauucaaauauguauccgcucaugagacaauaacccug

SEQ ID NO: 86 - DNA, 22 bp, Artificial Sequence
  Description of Artificial Sequence: Synthetic primer
gttaataacgaaatgagcagcc

SEQ ID NO: 87 - RNA, 197 nt, Artificial Sequence
  Description of Artificial Sequence: Synthetic polynucleotide
ggauccucuagagucgaccugcaggcaugcaagcuuggcacuggccgucguuuuacaacgucgugacugggaaaacccuggcguuacccaacuuaaucgccuugcagcacaucccccuuucgccagcuggcguaauagcgaagaggcccgcaccgaucgcccuucccaacaguugcgcagccugaauggcgaauggc

SEQ ID NO: 88 - RNA, 1956 nt, Artificial Sequence
  Description of Artificial Sequence: Synthetic polynucleotide
ggauccucuagagucgaccugcaggcaugcaagcuuggcacuggccgucguuuuacaacgucgugacugggaaaacccuggcguuacccaacuuaaucgccuugcagcacaucccccuuucgccagcuggcguaauagcgaagaggcccgcaccgaucgcccuucccaacaguugcgcagccugaauggcgaauggcgccugaugcgguauuuucuccuuacgcaucugugcgguauuucacaccgcauauggugcacucucaguacaaucugcucugaugccgcauaguuaagccagccccgacacccgccaacacccgcugacgcgcccugacgggcuugucugcucccggcauccgcuuacagacaagcugugaccgucuccgggagcugcaugugucagagguuuucaccgucaucaccgaaacgcgcgagacgaaagggccucgugauacgccuauuuuuauagguuaaugucaugauaauaaugguuucuuagacgucagguggcacuuuucggggaaaugugcgcggaaccccuauuuguuuauuuuucuaaauacauucaaauauguauccgcucaugagacaauaacccugauaaaugcuucaauaauauugaaaaaggaagaguaugaguauucaacauuuccgugucgcccuuauucccuuuuuugcggcauuuugccuuccuguuuuugcucacccagaaacgcuggugaaaguaaaagaugcugaagaucaguugggugcacgaguggguuacaucgaacuggaucucaacagcgguaagauccuugagaguuuucgccccgaagaacguuuuccaaugaugagcacuuuuaaaguucugcuauguggcgcgguauuaucccguauugacgccgggcaagagcaacucggucgccgcauacacuauucucagaaugacuugguugaguacucaccagucacagaaaagcaucuuacggauggcaugacaguaagagaauuaugcagugcugccauaaccaugagugauaacacugcggccaacuuacuucugacaacgaucggaggaccgaaggagcuaaccgcuuuuuugcacaacaugggggaucauguaacucgccuugaucguugggaaccggagcugaaugaagccauaccaaacgacgagcgugacaccacgaugccuguagcaauggcaacaacguugcgcaaacuauuaacuggcgaacuacuuacucuagcuucccggcaacaauuaauagacuggauggaggcggauaaaguugcaggaccacuucugcgcucggcccuuccggcuggcugguuuauugcugauaaaucuggagccggugagcgugggucucgcgguaucauugcagcacuggggccagaugguaagcccucccguaucguaguuaucuacacgacggggagucaggcaacuauggaugaacgaaauagacagaucgcugagauaggugccucacugauuaagcauugguaacugucagaccaaguuuacucauauauacuuuagauugauuuaaaacuucauuuuuaauuuaaaaggaucuaggugaagauccuuuuugauaaucucaugaccaaaaucccuuaacgugaguuuucguuccacugagcgucagaccccguagaaaagaucaaaggaucuucuugagauccuuuuuuucugcgcguaaucugcugcuugcaaacaaaaaaaccaccgcuaccagcggugguuuguuugccggaucaagagcuaccaacucuuuuuccgaagguaacuggcuucagcagagcgcagauaccaaauacuguccuucuaguguagccguaguuaggccaccacuucaagaacucuguagcaccgccuacauaccucgcucugcuaauccuguuaccaguggcugcugccaguggcgauaagucgugucuuaccggguuggacucaagacgauaguu

SEQ ID NO: 89 - DNA, 21 bp, Artificial Sequence
  Description of Artificial Sequence: Synthetic primer
tcgtcttgagtccaacccggt

SEQ ID NO: 90 - DNA, 39 bp, Artificial Sequence
  Description of Artificial Sequence: Synthetic oligonucleotide
gaacacagcattagcagctcgtcttgagtccaacccggt

SEQ ID NO: 91 - DNA, 58 bp, Artificial Sequence
  Description of Artificial Sequence: Synthetic oligonucleotide
aatgatacggcgaccaccgagatctacactctttccctacacgacgctcttccgatct

SEQ ID NO: 92 - DNA, 22 bp, Artificial Sequence
  Description of Artificial Sequence: Synthetic primer
agatcggaagagcgtcgtgtag

SEQ ID NO: 93 - DNA, 220 bp, Artificial Sequence
  Description of Artificial Sequence: Synthetic polynucleotide
ctgcagtaatacgactcactataggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggc

SEQ ID NO: 94 - DNA, 23 bp, Artificial Sequence
  Description of Artificial Sequence: Synthetic primer
acactctttccctacacgacgct

SEQ ID NO: 95 - DNA, 22 bp, Artificial Sequence
  Description of Artificial Sequence: Synthetic primer
gcgtcgtgtagggaaagagtgt

SEQ ID NO: 96 - DNA, 22 bp, Artificial Sequence
  Description of Artificial Sequence: Synthetic primer
cactctttccctacacgacgct

SEQ ID NO: 97 - DNA, 23 bp, Artificial Sequence
  Description of Artificial Sequence: Synthetic primer
agcgtcgtgtagggaaagagtgt

SEQ ID NO: 98 - DNA, 20 bp, Artificial Sequence
  Description of Artificial Sequence: Synthetic primer
acactttatgcttccggctc

SEQ ID NO: 99 - DNA, 19 bp, Artificial Sequence
  Description of Artificial Sequence: Synthetic primer
taagttgggtaacgccagg

SEQ ID NO: 100 - DNA, 11 bp, Artificial Sequence
  Description of Artificial Sequence: Synthetic primer
acactctttcc

SEQ ID NO: 101 - DNA, 9 bp, Artificial Sequence
  Description of Artificial Sequence: Synthetic primer
agcgtcgtg

SEQ ID NO: 102 - DNA, 44 bp, Artificial Sequence
  Description of Artificial Sequence: Synthetic primer
  Description of Combined DNA/RNA Molecule: Synthetic primer
ttccaatgatacggcgaccaccgauacugucauagctagctcct

SEQ ID NO: 103 - DNA, 43 bp, Artificial Sequence
  Description of Artificial Sequence: Synthetic primer
ggagctagctatgacagtatcggtggtcgccgtatcattactt

SEQ ID NO: 104 - DNA, 35 bp, Artificial Sequence
  Description of Artificial Sequence: Synthetic oligonucleotide
aaaaaaaaaaaaaaaaaaaaaaaaaaaaaaaaaaa

SEQ ID NO: 105 - DNA, 61 bp, Artificial Sequence
  Description of Artificial Sequence: Synthetic primer
  modified_base (37)..(44): a, c, t, g, unknown or other
ccgtgactggagttcagacgtgtgctcttccgatctnnnnnnnnttttttttttttttttt

SEQ ID NO: 106 - DNA, 34 bp, Artificial Sequence
  Description of Artificial Sequence: Synthetic primer
acactctttccctacacgacgctcttccgatctc

SEQ ID NO: 107 - DNA, 59 bp, Artificial Sequence
  Description of Artificial Sequence: Synthetic primer
aatgatacggcgaccaccgagatctacacgtactgacacactctttccctacacgacgc

SEQ ID NO: 108 - DNA, 53 bp, Artificial Sequence
  Description of Artificial Sequence: Synthetic primer
caagcagaagacggcatacgagatattactcggtgactggagttcagacgtgt

SEQ ID NO: 109 - DNA, 38 bp, Artificial Sequence
  Description of Artificial Sequence: Synthetic oligonucleotide
acactctttccctacacgacgctcttccgatctagggc

SEQ ID NO: 110 - DNA, 39 bp, Artificial Sequence
  Description of Artificial Sequence: Synthetic oligonucleotide
acactctttccctacacgacgctcttccgatctcagggc

SEQ ID NO: 111 - DNA, 40 bp, Artificial Sequence
  Description of Artificial Sequence: Synthetic oligonucleotide
acactctttccctacacgacgctcttccgatcttctgggc

SEQ ID NO: 112 - DNA, 35 bp, Artificial Sequence
  Description of Artificial Sequence: Synthetic oligonucleotide
acactctttccctacacgacgctcttccgatctgc

SEQ ID NO: 113 - DNA, 37 bp, Artificial Sequence
  Description of Artificial Sequence: Synthetic oligonucleotide
  Description of Combined DNA/RNA Molecule: Synthetic oligonucleotide
acactctttccctacacgacgctcttccgatctgggc

SEQ ID NO: 114 - DNA, 36 bp, Artificial Sequence
  Description of Artificial Sequence: Synthetic oligonucleotide
  Description of Combined DNA/RNA Molecule: Synthetic oligonucleotide
acactctttccctacacgacgctcttccgatctggg

SEQ ID NO: 115 - DNA, 35 bp, Artificial Sequence
  Description of Artificial Sequence: Synthetic oligonucleotide
  modified_base (34)..(34): a, c, t, g, unknown or other
acactctttccctacacgacgctcttccgatctnc

SEQ ID NO: 116 - DNA, 36 bp, Artificial Sequence
  Description of Artificial Sequence: Synthetic oligonucleotide
  modified_base (34)..(35): a, c, t, g, unknown or other
acactctttccctacacgacgctcttccgatctnnc

SEQ ID NO: 117 - DNA, 36 bp, Artificial Sequence; identical to SEQ ID NO: 116
  Description of Artificial Sequence: Synthetic oligonucleotide
  modified_base (34)..(34): a, c, t, g, unknown or other
  modified_base (35)..(35): ideoxyI

SEQ ID NO: 118 - DNA, 37 bp, Artificial Sequence
  Description of Artificial Sequence: Synthetic oligonucleotide
ccgtgactggagttcagacgtgtgctcttccgatctc

SEQ ID NO: 119 - DNA, 27 bp, Artificial Sequence
  Description of Artificial Sequence: Synthetic oligonucleotide
  CDS (1)..(27)
ggctccggcggcgcttctaccgcattg

SEQ ID NO: 120 - protein, 9 aa, Artificial Sequence
  Description of Artificial Sequence: Synthetic peptide
GSGGASTAL

SEQ ID NO: 121 - DNA, 21 bp, Artificial Sequence
  Description of Artificial Sequence: Synthetic oligonucleotide
  CDS (1)..(21)
aagaccgcgggtcgtcgtaac

SEQ ID NO: 122 - protein, 7 aa, Artificial Sequence
  Description of Artificial Sequence: Synthetic peptide
KTAGRRN

SEQ ID NO: 123 - DNA, 18 bp, Artificial Sequence
  Description of Artificial Sequence: Synthetic oligonucleotide
  CDS (1)..(18)
cgtgaacgttgcgctcaa

SEQ ID NO: 124 - protein, 6 aa, Artificial Sequence
  Description of Artificial Sequence: Synthetic peptide
RERCAQ

SEQ ID NO: 125 - DNA, 18 bp, Artificial Sequence
  Description of Artificial Sequence: Synthetic oligonucleotide
  CDS (1)..(15)
ggcggcggtgttggttaa

SEQ ID NO: 126 - protein, 5 aa, Artificial Sequence
  Description of Artificial Sequence: Synthetic peptide
GGGVG

SEQ ID NO: 127 - protein, 166 aa, Schistosoma mansoni
SSLLAFLQNESTLMDEEHVSTFLNSHAEFVFPRTWTPSRPKHPSHAPANVSRKKRRKIEYAHIQRLFHHRPKDASNTVLDGRWRNPYVANHSMIPDFDCFWTTVFTKTNSPDSREITPIIPMTPSLIDPILPSDVTWALKEMHGTAGGIDRLTSYDLMRFGKNGLA

SEQ ID NO: 128 - protein, 169 aa, Opisthorchis viverrini
SVDLLAFARGLQSGIMTPEQVLSLLDLHAFRTFPHTWKTVSRRRRQLAHRIPVNRKQIRRANFAAIQTLFHQRRKDSASAVLDGSWRDLYKGNCGLPTNAERPWKQVLSAPKRAGSRPSRIVVPSDWSLVEPITGEEVGRTIRLMGNSSPGLDKLTPRTLRRFNANVLA

SEQ ID NO: 129 - protein, 162 aa, Ciona intestinalis
PLSQFEPGKPSSSTKEAINTEYNDWISKWLPSGAAHRERRANPPSTKLNARATRRLQYSRIQNLYKLNRSACAQEVLSGAWKVQSGELNLKEVQPFWEKMFRKESAKDRRKPKPTGEVLWGLMEPLTIAEVGSTLKSTTPSAPGPDKLTLDGVKRIPIAELV

SEQ ID NO: 130 - protein, 159 aa, Ciona intestinalis
DMTAVNPGHPDPVIREEIDREFLRWLEPNRRRRGYAKATRIALNAPGKVRRRAEYAAMQRQWKTKRGLCAREALEGTWKIPARTVSLSDQEAFWRPLMESQSKNDLREPAKVGETLWGLLDPITPDEVRQILGSMSSKAPGPDGHRLSDLRSIPIDQIC

SEQ ID NO: 131 - protein, 130 aa, Ciona intestinalis
KFKQSKVKHNQKENKSKRQIRRAQYARTQINYKRNRQQAINSILSKQWRELDDRGPPLEHVLPFWQKLLEKSSEHDTRQPEPVSGPIWELVEPIVAEEVRLVRKSMPTSAPGPDGIRHKDFMAVQPQILA

SEQ ID NO: 132 - protein, 163 aa, Bombyx mori
ARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKA

SEQ ID NO: 133 - protein, 161 aa, Lasius niger
RTAIRRLEEGQSPEGALDDWWNNVFSDLEVTGRKRVARGPRAIPVLSKRKARRIEYRRMQQLWRTNMTKAAHKVLDGDAGSLPHPTLAAQLGFWKPVLEAESVDLAWPFAVGHPGVAVGDLWSPITEGEVINIRLPRTSSPGLDGLTVHRWFTEVPAILRA

SEQ ID NO: 134 - protein, 161 aa, Lasius niger
RAAVCRLREGCLPDAALDDWWRNVFSDLETARSGRISRGPRVAPVLSKRRARRVEYRRMQQLWKVNMTKAAHKVLDGDTDSLPHPTLAEQLDFWRPVLEASSASFVRPVGAGKVVDGLESVWSPITEGEVINIRLPPSSAPGLDGLTVNRWFAEVPAILRA

SEQ ID NO: 135 - protein, 159 aa, Nasonia vitripennis
RTAIEMALAGQSPLDVCTVGCYQYTMTNLPLVPVRLGGPIYWCNAQSRSNPGETQRRQTIKESNNSWKKNMSKAAHIVLDGDTDACPAGLEGTEASGAIMRAGCPTTRHLRSRMQGEIKNLWRPISNDEIKEVEACKRTAAGPDGMTTTAWNSIDECIK

SEQ ID NO: 136 - protein, 156 aa, Rhynchosciara americana
EAALCGKMLNEEQLIHCIKSMFNTAKCPKGPRFRKTATHSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKT

SEQ ID NO: 137 - protein, 156 aa, Bradysia coprophila
KVALLNQPMDEGRIMSWLSDRFPDTQKPKGPIYSKTTIYHGTNKQKRKQRYALVQSLYKKDISAAARVVLDENDKIATKIPPVRHMFDYWKDVFATGGGSAATNINRAPPAPHMETLWDPVSLIEIKSARASNEKGAGPDGVTPRSWNALDDRYKR

SEQ ID NO: 138 - protein, 167 aa, Tribolium castaneum
GDRLCDIARRACDGEDVSGQLLGWLRDVFPVKRVSTRGDQSDLDVDGASVSRRTARRREYARVQELYRKDPKACLARILGDRREGANRAPNRDPAFIDFWRGVFSEASAEVEGWAEEVSDHGELARRVWDPISVEEVGRSRVRNGAAPGPDGIAVSVWNKLPPEAAA

SEQ ID NO: 139 - protein, 153 aa, Tribolium castaneum
GDRLCNIARRACDGGDVSGQLLGWLRDVFPVKRVSTRGDQSNLDVDGALVSRHTARTREYARVQELYRKDPKACLARIFGDRREGANRAPNRDPAFIDFWRGVFSEASAEVEGCAEEVSDHGGGKVSGPEWCSAGARRNSGFRVEQLPPEAAA

SEQ ID NO: 140 - protein, 162 aa, Nuttalliella namaqua
GERLWEIARKAIRGEDIYRDLNDYVVDTFVVATKPHPQAKGKSYTTAPPSSRRKRRRRLYGRMQEMMRRKPADCAKIVLDGERVASKINSEEFFDYWEKLTTKEPSNWPLSSDTAQRENLKDPMFPVTLREIKENLPSPHSAPGPDGCSARLLRAVPPLTLQ

SEQ ID NO: 141 - protein, 159 aa, Drosophila melanogaster
QELQTIIDRAHLEGKETTLQCLSLYLLGIFPAQGVRHTLTRPPRRPRNRRESRRQQYAVVQRNWDKHKGRCIKSLLNGTDESVMPSQEIMVPYWREVMTQPSPSSCSGEVIQMDHSLERVWSAITEQDLRASRVSLSSSPGPDGITPKSAREVPSGIML

SEQ ID NO: 142 - protein, 149 aa, Drosophila mercatorum
EVLQSIIDRAHISGKEATLQCLSNYLLEIFPNRNDRPSSATVPARRPRNRRISRRQQYARCIKSLLDGTDESALPNQSIMEPYWRQVMTQPSPSLCSNTVPRKGNMQEGVWSPITSRDLQVHKVPLTSSPGPDGITSQTARSIPIGIML

SEQ ID NO: 143 - protein, 160 aa, Forficula auricularia
DELEALCDNICIWPTRLLITTVESYIRKLFKTTSTLKPAQKLHNPSNRNLPKRQLRRMEYGKTQKLWKKNPCRAIKTIIDDKDCKSPPEREAMTQYWKTTFSSKKRTCPQYEPRESTKTQLWEPVTIEELHCCHLEMTTSPGPDGITVRQLYLVPEQLLV

SEQ ID NO: 144 - protein, 159 aa, Lasius niger
TRLHNIAMEARTSGKDATLQKIALYLREVFPAPPPRRERRRKKTPNPAPMRKREARRCEYGAAQSLWKRDRRHCITNILNEMGPVNQPPRETMEPYWTRMMTTDGRTSPPSDKVPIKEDIWTPITGNDIKRSRIPRASAPGPDGISARLYRSIPTTVII

SEQ ID NO: 145 - protein, 159 aa, Bacillus rossius
  MOD_RES (92)..(92): Any amino acid
DRLRLIVRSVDDWSRARLHQEIGWFLRDLFWKPLTPNLARVSLPSKDKVSRRRLRRADYGRVQRAWKRNRNTCLRDLLRDKRTESAPPEELXVPYWESVLRSGSSCTPGQRGRTAERTELWDPVSSKEVEQALPPLGTAPGPDSFTPKDFRAVPSAVWA

SEQ ID NO: 146 - protein, 170 aa, Eyprepocnemis plorans
KLVDDIVALGPNTSRDIVRSMLPSALDAVGSKEPAAHPPLPFGARRPPDKKRARRRWEYAAVQRAFRKNAARCVNGLLDGTLLHQPPSIPGLVEFWKDLFTAPCASSRPRSKEGLSPMLLASSQPVSFRDLWAPITSEEAAAALPPRNSAAGPDALTPAQLRRLPHPVFL

SEQ ID NO: 147 - protein, 153 aa, Lepidurus couesii
DRLISDALRGVDVLENLDAYLLEVFAKPMAQNPCPKPPPPAKNSRERRDREYSRVQNFYKKNRSACINSILDGNTRSQNVIPGLTKFWTETFEKNSPPDDEAPDQFVADEPRDMYKWITFYEMSQDYLDSSTAPGVDGFSAKQLRSMSPRVLN

SEQ ID NO: 148 - protein, 153 aa, Lepidurus apus lubbocki
DRLITDALQGDDVLLNLDAYLLEVFAKPMAPNPCPKPLPPVKNSREKRDREYSRVQNFYKKNRSACINSILDGNTRSQNVIPDLMKFWTETFEKVSPADDKAPDQFVVDEPRDMYKWITFYEMSQNYLDPSTAPGVDGFSAKQLRSMTPRVLN

SEQ ID NO: 149 - protein, 154 aa, Lepidurus couesii
DQLIRTAQEGTPVLNDLDLYLREVLVQPTRQGERQAKPLPPPKSSREKRDREYARVQNFYRKNKTACVNAILDGNKKCENKIPDIDEFWKAIFESQSPPDAEPVSYVVDEEPKNIWSWISFFEMNRNYPDTSTSPGPDGVTARMLRSIPARVLN

SEQ ID NO: 150 - protein, 177 aa, Triops cancriformis
DNIIVQALKEDVNSDQVFNDLNSYLKLILEPSGRAKSVPGEIIHGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPPSTAPGPDGFSSKDLRRMTPRVLN

SEQ ID NO: 151 - protein, 161 aa, Trichinella murrelli
VMSCDLIKEATGMAMVDVNELQSNIRKLFSSGRKLPMKLRGAREAVQKKMANPRVAKFKRFQRLFRSNRRKLANHIFDKASLEQFGGSIDEASDHLERFLSRPRLESDSYSVISGDKSIGVAHPILAEEVELELKASRPTAVGPDGIGLEDIKKLNSYDLA

SEQ ID NO: 152 - protein, 161 aa, Trichinella sp.
VMSCDLIKQATGMAIVDINELQNNLRKVFSSGRNLPAKSHGVRESVPKKMANPRVAKFKRFQRLFRSNRRKLASHIFDKASLEQFGGSIDEASDHLEKFLSHPRLESDLYSAISGDNSIGIAHPILAEEVELELKATRPTAVGPDGIALEDIKRLNPYDIA

SEQ ID NO: 153 - protein, 161 aa, Trichinella britovi
VMSCDLIKEATGMAMVDINELQSNIRKVFSSGRKLPVKSRGARETVQKKMANPRVAKYKRFQRLFRSNRRKLASHIFDKASLEQFGGSIDEASDHLEKFLSRPRLESDSYSVINGNKSIGVAHPILAEEVELELKASRPTAVGPDGIALEDIKKLNSYDLA

SEQ ID NO: 154 - protein, 188 aa, Trichinella nelsoni
RDLRHHLEDSLTSCNSELEGLLNFLTNKILNSKPEDRNKYVDDVISIVTEFVCKPNGHQPPPAPKKRTKEEPKNRRQKIRSKYAKMQSLFKRDPKRIAAHLIKNQPLCNVSCPIDAAESALRQRLSQRPSVDAAPFTSKCPPNSKNILDPISPEEVTLHLQRMKIHTSAGPDGIQVSHLRSCDPVCLA

SEQ ID NO: 155 - protein, 194 aa, Schistosoma mansoni
TEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRS

SEQ ID NO: 156 - protein, 194 aa, Opisthorchis viverrini
EEVTRAPLKPHQRMDITRNYLIPRLTYSLVLGQVHRNTLKRLDNYIRQYIRGWLRLPKDTPISYIHAGKQHGGLGIPSLSATIPMQRKTRMEKLLSTQCRVLRNVVNDSAFGKIVRDLSLPIRVHGACVNTKEELVAAWGESLHNSADGRGLRELVTSPLSNRWLVFPERVFPRIFIRGIQLRCNLLRTRVRSA

SEQ ID NO: 157 - protein, 195 aa, Ciona intestinalis
AELSRAPLKPQQRLYLLRVHLLPKLQHGLVLSSCAKRALTYLDKSVRSAIRRWLTLPKDTPTAFYHAKACDGGLGITRLEHTIPILKRNRMMKLTLSEDPVIMELVKLTYFTNLLHKYSNVKLLNSWPVTDKDSLARAEASMLHTSVDGRGLSNCSDVPRQSDWVTNGASLLSGRDFIGAIKVRGNLLPTKVSAA

SEQ ID NO: 158 - protein, 197 aa, Ciona intestinalis
ANLSRAPLKPQQRLYILCTHLLPSIYHQLVLSSTSKKFLKYLDRCVRVAVRRWLRLPKDTPKAYFHAKCNDGGLGVPELQRVIPLQKAGRWLKMTRSQDPVVQAAVGLEYFQKLLERWSTPELYQWGGGGITTSGHLAVAQARSLYSSVNGRGLRQSGLVSTQFDWVRSGCSLLSGRNFIGAMQLRGNLLATKLRAS

SEQ ID NO: 159 - protein, 195 aa, Ciona intestinalis
KETTEAPLKPQQRIFILRNYILPRSLHILTFTNTTARLLKQLDSAIRIHVRRWLKLPKDTPLGYLYSDYKDGGLGVPRLLSRVPLLRIRRMAKYNTSEDPTTVALRSCHTFTSAAVKWAMPPKISNVVISDKRKERDFHRSELATSIDGSGLSCANTTPRAHQWVVNGTGLLSGKNYIGAINARGNLLHTASRAA

SEQ ID NO: 160 - protein, 197 aa, Bombyx mori
NNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGS

SEQ ID NO: 161 - protein, 184 aa, Lasius niger
ERITRAPLKPQQRLKILRTYLIPRYTHNLVLGRVSYSMLRKLDKQTRAAVRRWLVLPDDVPVAFFHCPIKQGGLGIQSFETAIPRLTLLRLNRLKDSQYEMARVVGSSAWADRRMRWCRFARRRDEDWPSELHAKVDGFELREAGNVSVSTRWLDDAMVHIPSSDWLQYVKVWINALPTRIRTT

SEQ ID NO: 162 - protein, 184 aa, Lasius niger
DRITRAPLKPQQRLKILKTFLIPRFIHILVLGRTSYGLLRKLDRQIRAAVRRWLRLPEDIPKAFFHSPIASGGLGILSYETAIPRLVLARLDRLDKSQYDAARMVGSSAWAVRKRRWCGLAKRVEENWPAEFYGMVDGFELREAGNVTASTNWLDDPMIRVPSSEWLEYVKVWINALPTRIRTT

SEQ ID NO: 163 - protein, 184 aa, Nasonia vitripennis
QRVTAAPLKPQQRMAILGMFLIPRFIHKLVLGRTSNADVRKGDKIIRKTVRGWLRLPHDTPIGYFHAPIKEGGLGIPAFESRIPELLKSRIEALGASNMQTARSLLGGDWVAERKKWINTQKIKNSEWAQKLHLTTDGKDLRDTRKAEASYSWIRDIHVAIPASVWIKYHHTRINALPTLMRMS

SEQ ID NO: 164 - protein, 194 aa, Rhynchosciara americana
ERLTKAPLKPQQRIHMLNAYVIPKYQDKLVLSKTTAKGLKRTDRQIRQYVRRWLKLPHDVPIAYLHAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTA

SEQ ID NO: 165 - protein, 196 aa, Bradysia coprophila
SKLTKGPLKPQQRIHLLKTFVIPKHLNRLVLSRTTATGLCKMDLLIRKYVRRWLRLPGDVPVAFLYAPVKAGGKGIPCLKQWIPLMRFLRLNKAKRTGGDRIAAVLNCQLYASISHSCKTGPVSVGLWRSTNTGGLSAYWRRILIGMVDGKDLKSAQNHSSATSFNSIRMNDISGEDYIHYNQLRTNSIPTRKRTA

SEQ ID NO: 166 - protein, 196 aa, Tribolium castaneum
KRITCAPLKPQQRMHLLRVFFLPKFYHAWTFGRLNAGVLRRLDVVVRTYVRTWLRFPHDIPVGYFHAPTKSGGLGIPQLSRFIPFLRLKRFDRLGRSAVDYVRECAFTDIADRKIRWCRERLSGIVDQVAGGRDALDAYWTAQLHQSVDGRALRESASVASSTQWLRCSTRAIPASDWLHYTAVHIGALPSRVRTS

SEQ ID NO: 167 - protein, 196 aa, Tribolium castaneum
KRNTCAPLKPQQRMHLLRVFFLPKFYHAWTFGRLNAGVLRRLNVVVRTSVRTWLRLPHDIPVGKFHAPTKSGGLGIPQLSRLIPFLRLKRFDRLGRSAVDYVRECAFTDIADQKIRWCRERLSGIVDQVAGGRDALDAYWTAQLHQSVDGRALRESASVASSTQWLRCSTRAIPASDWLHYTAVHIGALPSRVRTS

SEQ ID NO: 168 - protein, 195 aa, Nuttalliella namaqua
DRISSAPLKPQQRLYILRGFLVPRLIYRLVLGRWTAGTLLKLDRQIRAAIRRWIGLPHDCPLGYFHAKIGSGGLGIPSMRTMIPELLLRRLTKLEMNETMGTKEIPKCESYWYYVKKMEDLTKYDGHKLDTKYACQRYWAQKLYKSVDGRDLEASSKVPFANHWILDHTRWLPGYEYCKMVKFKVNAMPVLTRTS

SEQ ID NO: 169 - protein, 193 aa, Drosophila melanogaster
QRLTKAPLKPQQRLFALRTVLIPQLYHKLALGSVAIGVLRKTDKLIRYYVRRWLNLPLDVPIAFVHAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTT

SEQ ID NO: 170 - protein, 193 aa, Drosophila mercatorum
ERLMQSPLKPQQKLFALRTVLVPQLYHKLTLGSVALGVLRKCDKLVRSFARKLLGLPLDVSVAFYHAPHSCGGLGIPSVRWIAPMLRTKRLAGINWPHLEQSEVASAFLSEELRRARDRAKAGVNELLSQPKIDTYWADRLYTSVDGNGLREARRYAPQHGWVSQPTRLMSGKAYRTGIQLRINALPTRSRTT

SEQ ID NO: 171 - protein, 190 aa, Forficula auricularia
DVLTKAPLKPQQRLFALRVVILPSCYHILTLGGSNLSLLKKIDLMVRAAGRKWCCLPKDTPNAYFHASSRDGGLGLPSMRWLIPLHRYLRLLRYEGRNPEDTNVYLTTEINRAKIRLSDNGSNIDCQAKLWQFWADRLYKSVDGSALIESSKVPQQHRWATGGSRFLTGRDFINSIKLRINTLPTLSRTL

SEQ ID NO: 172 - protein, 191 aa, Lasius niger
GALTKAPLKPQQRLYALRTVVIPKLYHQLALGAVTIGTLNKTDRLVRGALRKWLALPHDTPNAYFHTSVRDGGLGIPAIRWTAPVQRRGRLLGVMKALGQQGLDRFIQDELNTCKKRLTDHGVLLGTPEMVAKRWAQQLYGSIDGAGLKDSAKTPHQHQWIADGSKFLTGKDFINCNRARIGALPTRSRTT

SEQ ID NO: 173 - protein, 194 aa, Bacillus rossius
EKLRRAPLKPQQRLYALRTVVVPGLYHLLVLGGTTISSLNRLDIAVRSTVRKWLSLPHDVPNAYIHADARDGGLSIPSYRWTVPRLRFHRLKALSVLCDGGGPDEMVACVGDEIKRASARLQDHGMNINTRNTYRVRFARLLHTSNDGAPLKGSKKVEGQHRWVTDGSLMLSGRDYIACNWVRINSIPLRKRTA

SEQ ID NO: 174 - protein, 193 aa, Eyprepocnemis plorans
DIIKRAPLKPQQRLFALRSVILPGTYHGLALGRTRLGALKSLDVCVRAAVRAWLRLPDDTPIGYFHAPVIYGGLGIPATRWLGPLLRRRRLASMEGLGVIVDEPSQDILKREICRLDNYLKWDGDVIKTSYQLGRFWALRLHSSVDGAALRRSAQTPGQHSWVSNTRLMLSGRDFLACVRARISALPSRARLL

SEQ ID NO: 175 - protein, 195 aa, Lepidurus couesii
NKLQKAPLKLQQKLYAVRNFVIPRALHGLILSKTNLKELNTLDRAIRVFLRTLLYLPKDTPLGFFHSPIKSGGLGITCFRTSVLKCRLQRIARMRSSCDGVIQAVAESDIFADEYAKLRDLIRINGNVLDTTESIKRYWAQRLHSSVDGKTLAYMDYFPQGNLWMSEDKVSQRSYVFADCVKLRINAIPTRVRVS

SEQ ID NO: 176 - protein, 195 aa, Lepidurus apus lubbocki
  MOD_RES (66)..(66): Any amino acid
  MOD_RES (105)..(105): Any amino acid
  MOD_RES (114)..(114): Any amino acid
  MOD_RES (125)..(125): Any amino acid
  MOD_RES (129)..(129): Any amino acid
  MOD_RES (159)..(159): Any amino acid
NKLQKAPLKIQQKLYAVRNFIIPRALHGLILSRTNLKELNTLDRAIRVFIRTLLHLPKDTPLGFFXAPIKTGGLGITCFRTTVLKCRLQRIARMRNCSDEVLEAXAESDTFDDXYAKLRDLIRIXGNVXDTTENIKKYWAQRLHSSVDGKTLAYMDYFXQGNLWMSEDKVSQRSYIFADCVKLRINAIPTRVRVS

SEQ ID NO: 177 - protein, 200 aa, Lepidurus couesii
  MOD_RES (131)..(131): Any amino acid
NKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVA

SEQ ID NO: 178 - protein, 195 aa, Triops cancriformis
NRLQKAPLKLQQKLYALRIYLIPRLIHGLTLSKTNLGELKTLDKLIRKYIRAWLHLPDDTPMGYFYTPLKAGGLGLPSLRLVILNNRLERILRMKASQDIIVRTIAESETLGVEIRKLHDLLSIDGTILDTSVKIHSFWAERLYSSYDGKCLCNSANFPPGNKWIGEDSLNQRSHIFADCLKLRINALPTRSRTA

SEQ ID NO: 179 - protein, 188 aa, Trichinella murrelli
KSVKSAPLKPEQKVALIRSHLLPRLQFLFSTAEVDSRKAWLIDSIIRGCVKEILHSVKAGMCTDIFYIPSRDGGMGLTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENL

SEQ ID NO: 180 - protein, 188 aa, Trichinella sp.
KSVKSAPLKPEQKVALIRSHLLPRLQFLFSTAEVDSRRAWLIDSIIRGCVKEILHSVKAGMCTDFFYIPSRDGGMGLTSLGEFSLFGRQKALAKMAGSSDPLSKRVAEFFIERWNIARDPKVIEAARRVYQKKRYQRFFRTYQSGGWNEFSGNTIGNAWLTNGRARGRNFIMAVKFRSNTAATRAENL

SEQ ID NO: 181 - protein, 188 aa, Trichinella britovi
KSVRSAPLKPEQKVALIRSHLLPRLQFLFSTAEADSRKAWLIDSIIRGCVKEILHSVKAGMCTEIFYIPSRDGGLGLTSLGEFSLFSRQKALAKMAGSSDPLSKRVAEFFMERWNIARDPKVTEAARRVYQKKRYQRFFQTYQSGGWNEFSGNTIGNAWLTNGRARGRNYVMAVKFRSNTAATRAENL

SEQ ID NO: 182 - protein, 199 aa, Trichinella nelsoni
ERIRKAPLKPAQKLATVRDYLIPSLEYKLGVPGISMKLLESVDAAIRLTVKRFLHLQITGMNSMFLTMPIKEGGLGLRPLTTQRIARVAVGTNSMMTSMDNVSRVVANTATLRKPLLSALEHFAVPAATKGAIREGKQNLLREEIAQLSETYQGSCLPSFKKGSLVNSWLRGTCGMRSRDYITGLKLRFGVIETRSQKW

SEQ ID NO: 183 - DNA, 28 bp, Artificial Sequence
  Description of Artificial Sequence: Synthetic oligonucleotide
  modified_base (24)..(28): a, c, t, g, unknown or other
acactctttccctacacgacgctnnnnn

SEQ ID NO: 184 - DNA, 28 bp, Artificial Sequence
  Description of Artificial Sequence: Synthetic oligonucleotide
  modified_base (1)..(5): a, c, t, g, unknown or other
nnnnnacactctttccctacacgacgct

SEQ ID NO: 185 - DNA, 28 bp, Artificial Sequence
  Description of Artificial Sequence: Synthetic oligonucleotide
  modified_base (24)..(28): a, c, t, g, unknown or other
agcgtcgtgtagggaaagagtgtnnnnn

SEQ ID NO: 186 - DNA, 28 bp, Artificial Sequence
  Description of Artificial Sequence: Synthetic oligonucleotide
  modified_base (1)..(5): a, c, t, g, unknown or other
nnnnnagcgtcgtgtagggaaagagtgt

SEQ ID NO: 187 - DNA, 29 bp, Artificial Sequence
  Description of Artificial Sequence: Synthetic oligonucleotide
  modified_base (1)..(5): a, c, t, g, unknown or other
nnnnnacactctttccctacacgacgcta

SEQ ID NO: 188 - DNA, 29 bp, Artificial Sequence
  Description of Artificial Sequence: Synthetic oligonucleotide
  modified_base (1)..(5): a, c, t, g, unknown or other
nnnnnagcgtcgtgtagggaaagagtgta

SEQ ID NO: 189 - protein, 4 aa, Artificial Sequence
  Description of Artificial Sequence: Synthetic peptide
PGPD

SEQ ID NO: 190 - protein, 4 aa, Artificial Sequence
  Description of Artificial Sequence: Synthetic peptide
GGLA

SEQ ID NO: 191 - DNA, 11 bp, Artificial Sequence
  Description of Artificial Sequence: Synthetic oligonucleotide
acactctttcc

SEQ ID NO: 192 - DNA, 48 bp, Artificial Sequence
  Synthetic Sequence
ggctccggcggcgcttctaccgcattgaagaccgcgggtcgtcgtaac

SEQ ID NO: 193 - protein, 16 aa, Artificial Sequence
  Synthetic Sequence
GSGGASTALKTAGRRN

SEQ ID NO: 194 - DNA, 36 bp, Artificial Sequence
  Synthetic Sequence
cgtgaacgttgcgctcaaggcggcggtgttggttaa

SEQ ID NO: 195 - protein, 11 aa, Artificial Sequence
  Synthetic Sequence
RERCAQGGGVG

SEQ ID NO: 196 - protein, 165 aa, Unknown
  Synthetic Sequence
SSLLAFLQNESTLMDEEHVSTFLNSHARFVFPRTWTPSRPKHPAHARANVSRKKRRKIEYAMIQRLFMMRPKDASNTVLDGRWNPYVANHSMIPDFDCFWTTVFTKTNSPDSREITPIIPMTPSLIDPILPSDVTWALKEMHGTAGGIDRLTSYDLMRFGKNGLA

SEQ ID NO: 197 - protein, 169 aa, Unknown
  Synthetic Sequence
SVDLLAFARGLQSGIMTPEQVLSLLDLHAFRTFPHTWKTVSRRRRQLAHRIPVNRKQIRRANFAAIQTLFMQRRKDSASAVLDGSWRDLYKGNCGLPTNAERPWKQVLSAPKRAGSRPSRIVVPSDWSLVEPITGEEVGRTIRLMGNSSPGLDKLTPRTLRRFNANVLA

SEQ ID NO: 198 - protein, 121 aa, Unknown
  Synthetic Sequence
PLSQFEPGKPSSSTKEAINTEYNDWISKWLPSGAAMRERRANPPSTKLNARATRRLQYSRIQNLYKLNRSACAQEVLSGAWKVQSGELNLKEVQPFWEKMFRKESAKDRRKPKPTGEVLWG

SEQ ID NO: 199 - protein, 159 aa, Unknown
  Synthetic Sequence
DMTAVNPGHPDPVIREEIDREFLRWLERNRRRRGYAKATRIALNAPGKVRRRAEYAAMQRQWKTKRGLCAREALEGTWKIPARTVSLSDQEAFWRPLMESQSKNDLREPAKVGETLWGLLDPITPDEVRQILGSMSSKAPGPDGHRLSDLRSIPDDQIC

SEQ ID NO: 200 - protein, 130 aa, Unknown
  Synthetic Sequence
KFKQSKVKHNQKENKSKRQIRRAQYARTQINYKRNRQQAINSILSKQWRELDDRGPPLEMVLPFWQKLLEKSSEHDTRQPEPVSGPIWELVEPIVAEEVRLVRKSMPTSAPGPDGIRHKDFMAVQPQILA

SEQ ID NO: 201 - protein, 163 aa, Unknown
  Synthetic Sequence
ARVLSELLEGAGRRRACRAMRPKTAGRRNDLMDDRTASAMKTSRQKRRAEYARVQELYKKCRSRAAAEVIDGACGGVGMSLEEMETYWRPILERVSDAPGPTPEALHALGRAEWHGCNRDYTQLWKPISVEEIKASRFDWRTSPGPDGIRSGQWRAVPVHLKA

SEQ ID NO: 202 - protein, 160 aa, Unknown
  Synthetic Sequence
RTAIRRLEEGQSPEGALDDWWNNVFSDLEVGRKRVARGPRAIPVLSKRKARRIEYRRMQQLWRTNMTKAAHKVLDGDAGSLPHPTLAAQLGFWKPVLEAESVDLAWPFAVGMPGVAVGDLWSPITEGEVINIRLPRTSSPGLDGLTVHRWFTEVPAILRA

SEQ ID NO: 203 - protein, 160 aa, Unknown
  Synthetic Sequence
RAAVCRLREGCLPDAALDDWWRNVFSDLETARSGRISRGPRVAPVLSKRRARRVEYRRMQQLWKVNMTKAAHKVLDGDTDSLPHPTLAEQLDFWRPVLEASSASFRPVGAGKVVDGLESVWSPITEGEVINIRLPFSSAPGLDGLTVNRWFAEVPAILRA

SEQ ID NO: 204 - protein, 159 aa, Unknown
  Synthetic Sequence
RTAIEMALAGQSPLDVCTVGCYQYTMINLPLVPVRLGGPIYWCNAQSRSNPGETQRRQTIKESNNSWKKNMSKAAHIVLDGDTDACPAGLEGTEASGAIMRAGCPTTRHLRSRMQGEIKNLWRPISNDEIKEVEACKRTAAGPDGMITTAWNSIDECIK

SEQ ID NO: 205 - protein, 156 aa, Unknown
  Synthetic Sequence
EAALCGKMLNEEQLIMCIKSMFNTAKCPKGPRFRKTATMSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKT

SEQ ID NO: 206 - protein, 155 aa, Unknown
  Synthetic Sequence
KVALLNQPMDEGRIMSWLSDRFPDTQKPKPIYSKTTIYMGTNKQKRKQRYALVQSLYKKDISAAARVVLDENDKIATKIPPVRHMFDYWKDVFATGGGSAATNINRAPPAPHMETLWDPVSLIEIKSARASNEKGAGPDGVIPRSWNALDDRYKR

SEQ ID NO: 207 - protein, 167 aa, Unknown; identical to SEQ ID NO: 138
  Synthetic Sequence

SEQ ID NO: 208 - protein, 153 aa, Unknown; identical to SEQ ID NO: 139
  Synthetic Sequence

SEQ ID NO: 209 - protein, 162 aa, Unknown
  Synthetic Sequence
GERLWEIARKAIRGEDITRDLNDYVVDTFVVATKPMPQAKGKSYTTAPPSSRRKRRRRLYGRMQEMMRRKPADCAKIVLDGERVASKINSEEFFDYWEKLTTKEPSNWPLSSDTAQRENLKDPMFPVTLREIKENLPSFHSAPGPDGCSARLLRAVPPLTLQ

SEQ ID NO: 210 - protein, 159 aa, Unknown
  Synthetic Sequence
QELQTIIDRAHLEGKETTLQCLSLYLLGIFPAQGVRHTLTRPPRRPRNRRESRRQQYAVVQRNWDKMKGRCIKSLLNGTDESVMPSQEIMVPYWREVMTQPSPSSCSGEVIQMDHSLERVWSAITEQDLRASRVSLSSSPGPDGITPKSAREVPSGIML

SEQ ID NO: 211 - protein, 149 aa, Unknown
  Synthetic Sequence
EVLQSIIDRAMISGKEATLQCLSNYLLEIFPNRNDRPSSATVPARRPRNRRISRRQQYARCIKSLLDGTDESALPNQSIMEPYWRQVMTQPSPSLCSNTVPRKGNMQEGVWSPITSRDLQVHKVPLTSSPGPDGITSQTARSIPIGIML

SEQ ID NO: 212 - protein, 160 aa, Unknown
  Synthetic Sequence
DELEALCDNICIWPTRLLITTVESYIRKLFKTTSTLKPAQKLHNPSNRNLPKRQLRRMEYGKTQKLWKKNPCRAIKTIIDDKDCKSPPEREAMTQYWKITESSKKRTCPQYEPRESTKTQLWEPVTIEELHCCHLEMTTSPGPDGITVRQLYLVPEQLLV

SEQ ID NO: 213 - protein, 159 aa, Unknown; identical to SEQ ID NO: 144
  Synthetic Sequence

SEQ ID NO: 214 - protein, 158 aa, Unknown
  Synthetic Sequence
  misc_feature (91)..(91): Xaa can be any naturally occurring amino acid
DRLRLIVRSVDDWSRARLQEIGWFLRDLFWKPLTPNLARVSLPSKDKVSRRRLRRADYGRVQRAWKRNRNTCLRDLLRDKRTESAPPEELXVPYWESVLRSGSSCTPGQRGRTAERTELWDPVSSKEVEQALPPLGTAPGPDSFTPKDFRAVPSAVWA

SEQ ID NO: 215 - protein, 169 aa, Unknown
  Synthetic Sequence
KLVDDIVALGPNTSRDIVRSMLPSALDAVGSKEPAAPPLPFGARRPPDKKRARRRWEYAAVQRAFRKNAARCVNGLLDGTLLHQPPSIPGLEEFWKDLFTAPCASSRPRSKEGLSPMLLASSQPVSFRDLWAPITSEEAAAALPPRNSAAGPDALTPAQLRRLPHPVFL

SEQ ID NO: 216 - protein, 153 aa, Unknown; identical to SEQ ID NO: 147
  Synthetic Sequence

SEQ ID NO: 217 - protein, 153 aa, Unknown
  Synthetic Sequence
DRLITDALQGDDVLLNLDAYLLEVFAKPMAPNPCPKPLPPVKNSREKRDREYSRVQNFYKKNRSACINSILDGNTRSQNVIPDLMKFWTETFEKVSPADDKAPDQFVVDEPRDMYKWITFYEMSQNYLDRSTAPGVDGFSAKQLRSMTPRVLN

SEQ ID NO: 218 - protein, 154 aa, Unknown; identical to SEQ ID NO: 149
  Synthetic Sequence

SEQ ID NO: 219 - protein, 177 aa, Unknown
  Synthetic Sequence
DNIIVQALKEDVNSDQVFNDLNSYLKLILEPSGRAKSVPGEIIMGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPRSTAPGPDGFSSKDLRRMTPRVLN

SEQ ID NO: 220 - protein, 160 aa, Unknown
  Synthetic Sequence
VMSCDLIKEATGMAMVDVNELQSNIRLFSSGRKLPMKLRGAREAVQKKMANPRVAKFKRFQRLFRSNRRKLANHIFDKASLEQFGGSIDEASDHLERFLSRPRLESDSYSVISGDKSIGVAMPILAEEVELELKASRPTAVGPDGIGLEDIKKLNSYDLA

SEQ ID NO: 221 - protein, 161 aa, Unknown
  Synthetic Sequence
VMSCELIKQATGMAIVDINELQNNLRKVFSSGRNLPAKSHGVRESVPKKMANPRVAKFKRFQRLFRSNRRKLASHIFDKASLEQFGGSIDEASDHLEKFLSHPRLESDLYSAISGDNSIGIAMPILAEEVELELKATRPTAVGPDGIALEDIKRLNPYDIA

SEQ ID NO: 222 - protein, 161 aa, Unknown
  Synthetic Sequence
VMSCDLIKEATGMAMVDINELQSNIRKVFSSGRKLPVKSRGARETVQKKMANPRVAKYKRFQRLFRSNRRKLASHIFDKASLEQFGGSIDEASDHKEKFLSRPRLESDSYSVINGNKSIGVAMPILAEEVELELKASRTTAVGPDGIALEDIKKLNSYDLA

SEQ ID NO: 223 - protein, 186 aa, Unknown
  Synthetic Sequence
RDLRLEDSLTSCNSELEGLLNFLTNKILNSKPEDRNKYVDDVISIVTEFVCKPNGHQPPPAPKKRTKEEPKNRRQKIRSKYAKMQSLFKRDPKRIAAHLIKNQPLCNVSCPIDAAESALRQRLSQRPSVDAAPETSKCPPNSKNILDPISPEEVTLHLQRMKIHTSAGPDGIQVSHLRSCDPVCLA

SEQ ID NO: 224 - protein, 193 aa, Unknown
  Synthetic Sequence
TEISCAPLKPQQRHKILKDNLLPRLLYPLTLGIVHLKTLKSHDRNIHTAIRKWLRLPSDTPLAYFSPVAAGGLGILHLSSSVPFHRRKRLETLLSSPNRLLMKLPTSPTLASYSHLSQLPVRIGHETVTSREEASHSWVRRKSSCDGKGLLLAPLSTESHAWLRYPQSIFPSVYINAVKLRGGLLSTKVRRSI

SEQ ID NO: 225 - protein, 194 aa, Unknown
  Synthetic Sequence
EEVTRAPLKPHQRHDITRNYLIPRLTYSLVLGQVHRNTLKRLDNYIRQYIRGWLRLPKDTPISYIHAGKQGGLGIPSLSATIPMQRKTRHEKLLSTQCRVLRNVVNDSAFGKIVRDLSLPIRVHGACVNTKEELVAAWGESLHNSADGRGLRELVTSPLSNRWLVFPEHVFPRIFIRGIQLRCNLLRTRVRSAI

SEQ ID NO: 226 - protein, 196 aa, Unknown
  Synthetic Sequence
AELSRAPLKPQQRLYLLRVHLLPKLQHGLVLSSCAKRALTYLDKSVRSAIRRWLTLPKDTPTAFYMAKACDGGLGITRLEMTIPILKRNRMMKLTLSEDPVIHELVKLTYFTNLLHKYSNVKLLNSWPVTDKDSLARAEASMLHTSVDGRGLSNCSDVPRQSDWVTNGASLLSGRDFIGAIKVRGNLLPTKVSAAI

SEQ ID NO: 227 - protein, 196 aa, Unknown
  Synthetic Sequence
ANLSRAPLKPQQRLYILCTMLLPSIYMQLVLSSTSKKFLKYLDRCVRVAVRRWLRLPKDTPKAYFAKCNDGGLGVPELQRVIPLQKAGRWLKMTRSQDPVVQAAVGLEYFQKLLETWSTPELYQWGGGGITTSGLAVAQARSLYSSVNGRGLRQSGLVSTQFDWVRSGCSLLSGRNFIGAMQLRGNLLATKLRASI

SEQ ID NO: 228 - protein, 196 aa, Unknown
  Synthetic Sequence
KETTEAPLKPQQRIFILRNYILPRSLMILTFTNTTARLLKQLDSAIRIMVRRWLKLPKDTPLGYLYSDYKDGGLGVPRLLSRVPLLTIRRHAKYNTSEDPTTVALRSCMTFTSAAVKWAMPPKISNVVISDKRKERDFMRSELATSIDGSGLSCANTTPRAHQWVVNGTCLLSGKNYIGAINARGNLLHTASRAAI

SEQ ID NO: 229 - protein, 198 aa, Unknown
  Synthetic Sequence
NNISRAPLKPQQRLEILRAHLIPRFQHGFVLGNISDDRLRHLDVQIRKAVGQWLRLPADVPKAYYMAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSI

SEQ ID NO: 230 - protein, 183 aa, Unknown
  Synthetic Sequence
ERITRAPLKPQQRLKILRTYLIPRYRHNLVLGRVSYSHLRKLDKQTRAAVRRWLVLPDDVPVAFFCPIKQGGLGIQSFETAIPRLTLLRLNRLKDSQYEMARVVGSSAWADRRMRWCRFARRRDEDWPSELAKVDGFELREAGNVSVSTRWLDDAMVHIPSSDWLQYVKVWINALPTRIRTTI

SEQ ID NO: 231 - protein, 184 aa, Unknown
  Synthetic Sequence
DRITRAPLKPQQRLKILKTFLIPRFIHILVLGRTSYGLLRKLDRQIRAAVRRWLRLPEDIPKAFFSPIASGGLGILSYETAIPRLVLARLDRLDKSQYDAARMVGSSAWAVRKRRWCGLAKRVEENWPAEFYGMVDGFELREAGNVTASTNWLDDPHIRVPSSEWLEYVKVWINALPTRIRTTI

SEQ ID NO: 232 - protein, 180 aa, Unknown
  Synthetic Sequence
QRVTAAPLKPQQRHAILGFLIPRFIHKLVLGRTSNADVRKGDKIIRKTVRGWLRLPHDTPIGYFAPIKEGGLGIPAFESRIPELLKSRIEALGASNMQTARSLLGGDWVAERKKWINTQKIKNSEWAQKLLTTDGKDLRDTRKAEASYSWIRDIHVAIPASVWIKYTRINALPTLMRMSI

SEQ ID NO: 233 - protein, 195 aa, Unknown
  Synthetic Sequence
ERLTKAPLKPQQRIHMLNAYVIPKYQDKLVLSKTTAKGLKRTDRQIRQYVRRWLKLPMDVPIAYLMAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTAI

SEQ ID NO: 234 - protein, 196 aa, Unknown
  Synthetic Sequence
SKLTKGPLKPQQRIHLLKTFVIPKHLNRLVLSRTTATGLCKMDLLIRKYVRRWLRLPGDVPVAFLYAPVKAGGKGIPCLKQWIPLMRFLRLNKAKRTGGDRIAAVLNCQLYASISHSCKTGPVSVGLMRSTNTGGLSAYWRRILIGHVDGHLKSAQNHSSATSFNSIRMNDISGEDYIHYNQLRTNSIPTRKRTAI

SEQ ID NO: 235 - protein, 194 aa, Unknown
  Synthetic Sequence
KRITCAPLKPQQRHLLRVFFLPKFYHAWTFGRLNAGVLRRLDVVVRTYVRTWLRFPHDIPVGYFAPTKSGGLGIPQLSRFIPFLRLKRFDRLGRSAVDYVRECAFTDIADRKIRWCRERLSGIVDQVAGGRDALDAYWTAQLQSVDGRALRESASVASSTQWLRCSTRAIPASDWLHYTAVHIGALPSRVRTSI

SEQ ID NO: 236 - protein, 196 aa, Unknown
  Synthetic Sequence
KRNTCAPLKPQQRMMLLRVFFLPKFYMAWTFGRLNAGVLRRLNVVVRTSVRTWLRLPDIPVGKFMAPTKSGGLGIPQLSRLIPFLRLKRFDRLGRSAVDYVRECAFTDIADQKIRWCRERLSGIVDQVAGGRDALDAYWTAQLHQSVDGRALRESASVASSTQWLRCSTRAIPASDWLHYTAVMIGALPSRVRTSI

SEQ ID NO: 237 - protein, 195 aa, Unknown
  Synthetic Sequence
DRISSAPLKPQQRLYILRGFLVPRLIYRLVLGRWTAGTLLKLDRQIRAAIRRWIGLPHDCPLGYFAKIGSGGLGIPSMRTMIPELLLRRLTKLEMNETMGTKEIPKCESYWYYVKKMEDLTKYDGHKLDTKYACQRYWAQKLYKSVDGRDLEASSKVPFANHWILDHTRWLPGYEYCKMVKFKVNAHPVLTRTSI

SEQ ID NO: 238 - protein, 193 aa, Unknown
  Synthetic Sequence
QRLTKAPLKPQQRLFALRTVLIPQLYHKLALGSVAIGVLRKTDKLIRYYVRRWLNLPLDVPIAFVAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTTI

SEQ ID NO: 239 - protein, 193 aa, Unknown
  Synthetic Sequence
ERLMQSPLKPQQKLFALRTVLVPQLYHKLTLGSVALGVLRKCDKLVRSFARKLLGLPLDVSVAFYMAPSCGGLGIPSVRWIAPMLRTKRLAGINWPHLEQSEVASAFLSEELRRARDRAKAGVNELLSQPKIDTYWADRLYTSVDGNGLREARRYAPQHGWVSQPTRLMSGKAYRTGIQLRINALPTRSRTTI

SEQ ID NO: 240 - protein, 190 aa, Unknown
  Synthetic Sequence
DVLTKAPLKPQQRLFALRVVILPSCYHILTLGGSNLSLLKKIDLMVRAAGRKWCCLPKDTPNAYFHASSRDGGLGLPSMRWLIPLMRYRLLRYEGRNPEDTNVYLTTEINRAKIRLSDNGSNIDCQAKLWQFWADRLYKSVDGSALIESSKVPQQHRWATGGSRFLTGRDFINSIKLRINTLPTLSRTLI

SEQ ID NO: 241 - protein, 191 aa, Unknown
  Synthetic Sequence
GALTKAPLKPQQRLYALRTVVIPKLYHQLALGAVTIGTLNKTDRLVRGALRKWLALPHDTPNAYFHTSVRDGGLGIPAIRWTAPVQRRRLLGVMKALGQQGLDRFIQDELNTCKKRLTDHGVLLGTPEMVAKRWAQQLYGSIDGAGLKDSAKTPHQHQWIADGSKFLTGKDFINCNRARIGALPTRSRTTI

SEQ ID NO: 242 - protein, 194 aa, Unknown
  Synthetic Sequence
EKLRRAPLKPQQRLYALRTVVVPGLYHLLVLGGTTISSLNRLDIAVRSTVRKWLSLPHDVPNAYIHADARDGGLSIPSYRWTVPRLRFHRLALSVLCDGGGPDEMVACVGDEIKRASARLQDHGMNINTRNTYRVRFARLLHTSNDGAPLKGSKKVEGQHRWVTDGSLMLSGRDYIACNWVRINSIPLRKRTAI

SEQ ID NO: 243 - protein, 193 aa, Unknown
  Synthetic Sequence
DIIKRAPLKPQQRLFALRSVILPGTYHGLALGRTRLGALKSLDVCVRAAVRAWLRLPDDTPIGYFHAPVIYGGLGIPATRWLGPLLRRRRLSMEGLGVIVDEPSQDILKREICRLDNYLKWDGDVIKTSYQLGRFWALRLHSSVDGAALRRSAQTPGQHSWVSNTRLMLSGRDFLACVRARISALPSRARLLI

SEQ ID NO: 244 - protein, 195 aa, Unknown
  Synthetic Sequence
NKLQKAPLKLQQKLYAVRNFVIPRALHGLTLSKTNLKELNTLDRAIRVFLRTLLYLPKDTPLGFFHSPIKSGGLGITCFRTSVLKCRLQRLRMRSSCDGVIQAVAESDIFADEYAKLRDLIRINGNVLDTTESIKRYWAQRLHSSVDGKTLAYMDYFPQGNLWMSEDKVSQRSYVFADCVKLRISAIPTRVRVSI

SEQ ID NO: 245 - protein, 195 aa, Unknown
  Synthetic Sequence
NKLQKAPLKIQQKLYAVRNFIIPRALHGLTLSRTNLKELNTLDRAIRVFIRTLLHLPKDTPLGFFKAPIKTGGLGITCFRTTVLKCRLQRLRMRNCSDEVLEAKAESDTFDDKYAKLRDLIRIKGNVKDTTENIKKYWAQRLHSSVDGKTLAYMDYFKQGNLWMSEDKVSQRSYIFADCVKLRINAIPTRVRVSI

SEQ ID NO: 246 - protein, 199 aa, Unknown
  Synthetic Sequence
NKLQKSPLKLQQKLFALRVYLIPRLLHGLVLSRVAIGELKIMDKLTLKHLRVWLRLPKDTPLGFFYSPVKLGGLGIKNLRTNVLKCRKQRIRMLVSPDDVVRLVAESETFLKETDKLKDLLTINBCLDKRNVPRTGKNNKFWSERLYTSFDGKTLAYSEYFTQGGGWIREDKILQPAHVFAECIKLRINALPTKSRVAI

SEQ ID NO: 247 - protein, 195 aa, Unknown
  Synthetic Sequence
NRLQKAPLKLQQKLYALRIYLIPRLIHGLTLSKTNLGELKTLDKLIRKYIRAWLHLPDDTPMGYFYTPLKAGGLGIKNLRTNVLKCRKQRIRMKASQDIIVRTIAESETLGVEIRKLHDLLSIDGTILDTSVKINSFWAERLYSSYDGKCLCNSANFPPGNKWIGEDSLNQRSHIFADCLKLRINALPTRSRTAI

SEQ ID NO: 248 - protein, 188 aa, Unknown
  Synthetic Sequence
KSVKSAPLKPEQKVALIRSHLLPRLQFLFSTAEVDSRKAWLTDSIIRGCVKEILHSVKAGMCTDIFYIPSRDGGMGLTSLGEFSLFSRQKALKMAGSSDPLSKRVAEFFIERHNIARDPKVIEAARRVYQKKRYQRFFQTYQSGGHNEFSGNTIGNAWLTNGRARGRNFIMAVKFRSNTAATRAENLI

SEQ ID NO: 249 - protein, 188 aa, Unknown
  Synthetic Sequence
KSVKSAPLKPEQKVALIRSHLLPRLQFLTSTAEVDSRRAWLTDSIIRGCVKEILHSVKAGMCTDFFYIPSRDGGMGLTSLGEFSLFGRQKALKMAGSSDPLSKRVAEFFIERHNIARDPKVIEAARRVYQKKRYQRFFRTYQSGGHNEFSGNTIGNAWLTNGRARGRNFIMAVKFRSNTAATRAENLI

SEQ ID NO: 250 - protein, 188 aa, Unknown
  Synthetic Sequence
KSVRSAPLKPEQKVALIRSHLLPRLQFLFSTAEADSRKAWLTDSIIRGCVKEILHSVKAGMCTEIFYIPSRDGGLGLTSLGEFSLTSRQKALKMAGSSDPLSKRVAEFFHERHNIARDPKVIEAARRVYQKKRYQRFFQTYQSGGHNEFSGNTIGNAWLTNGRARGRNYVMAVKFRSNTAATRAINLI

SEQ ID NO: 251 - protein, 199 aa, Unknown
  Synthetic Sequence
ERIRKAPLKPAQKLATVRDYLIPSLEYKLGVPGISMKLLESVDAAIRLTVKRFLHLQITGMNSMFLTMPIKEGGLGLRPLTTQRIARVAVGTSMMTSMDNVSRVVANTATLRKPLLSALEHFAVPAATKGAIREGHQNLLREEIAQLSETYQGSCLPSFKKGSLVNSWLRGTCGMRSRDYITGLKLRFGVIETRSQKWI

SEQ ID NO: 252 - DNA, 11 bp, Artificial Sequence
  Synthetic Sequence
acactctttcc

SEQ ID NO: 253 - DNA, 23 bp, Artificial Sequence
  Synthetic Sequence
acactctttccctacacgacgct

SEQ ID NO: 254 - DNA, 20 bp, Artificial Sequence
  Synthetic Sequence
cactcttcctacacgacgct

SEQ ID NO: 255 - DNA, 39 bp, Artificial Sequence
  Synthetic Sequence
ttccatgatacggcgaccaccgaacgcaagctagctcct

SEQ ID NO: 256 - DNA, 28 bp, Artificial Sequence
  Synthetic Sequence
  misc_feature (24)..(28): n is a, c, g, or t
acactctttccctacacgacgctnnnnn

SEQ ID NO: 257 - DNA, 29 bp, Artificial Sequence
  Synthetic Sequence
  misc_feature (1)..(5): n is a, c, g, or t
nnnnnacactctttccctacacgacgcta

SEQ ID NO: 258 - DNA, 43 bp, Artificial Sequence; identical to SEQ ID NO: 103
  Synthetic Sequence

SEQ ID NO: 259 - DNA, 39 bp, Artificial Sequence
  Synthetic Sequence
ttcaatgatacggcgaccaccgaacgcaagctagctcct

SEQ ID NO: 260 - DNA, 23 bp, Artificial Sequence
  Synthetic Sequence
agcgtcgtgtagggaaagagtgt

SEQ ID NO: 261 - DNA, 22 bp, Artificial Sequence
  Synthetic Sequence
gcgtcgtgtagggaaagagtgt

SEQ ID NO: 262 - DNA, 44 bp, Artificial Sequence
  Synthetic Sequence
ggagctagctatgacagtatgcggtggtcgccgtatcattactt

SEQ ID NO: 263 - DNA, 28 bp, Artificial Sequence
  Synthetic Sequence
  misc_feature (24)..(28): n is a, c, g, or t
agcgtcgtgtagggaaagagtgtnnnnn

SEQ ID NO: 264 - DNA, 29 bp, Artificial Sequence
  Synthetic Sequence
  misc_feature (1)..(5): n is a, c, g, or t
nnnnnagcgtcgtgtagggaaagagtgta

What is claimed is:

1. A method for preparing complementary deoxyribonucleic acid (cDNA), the method comprising:
    (a) providing a single vessel comprising an R2 reverse transcription enzyme and one or more template ribonucleic acid molecules; and
    (b) in said single vessel, using said R2 reverse transcription enzyme to perform an amplification reaction on said one or more template ribonucleic acid molecules to yield a plurality of complementary deoxyribonucleic acid molecules,
    wherein said R2 reverse transcription enzyme comprises one of the following amino acid sequences: SEQ ID NO: 49, SEQ ID NO: 50, SEQ ID NO: 51, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, and SEQ ID NO: 67.

2. The method of claim 1, wherein said one or more template ribonucleic acid molecules are from a single cell provided in said single vessel prior to (a).

3. The method of claim 1, wherein said one or more template ribonucleic acid molecules are present in an amount up to about 100 nM.

4. The method of claim 1, wherein said R2 reverse transcription enzyme is configured to perform said amplification reaction at a substantially constant temperature.

5. The method of claim 1, wherein said R2 reverse transcription enzyme is configured to perform said amplification reaction at a temperature of from about 12° C. to about 42° C.

6. The method of claim 1, wherein said R2 reverse transcription enzyme has a misincorporation error rate of at most about 1 base out of 100 bases.

7. The method of claim 6, wherein said R2 reverse transcription enzyme has a misincorporation error rate of at most about 1 base out of 10,000 bases.

8. The method of claim 1, wherein said R2 reverse transcription enzyme is configured to generate said plurality of complementary deoxyribonucleic acid molecules from said one or more template ribonucleic acid molecules with a specific activity of from about 20,000 units/mg to about 140,000 units/mg.

9. The method of claim 1, wherein said one or more template ribonucleic acid (RNA) molecules comprise messenger RNA, ribosomal RNA, transfer RNA, micro RNA, long non-coding RNA, vault RNA, signal recognition particle RNA, small RNA, small nuclear, small nucleolar RNA, small conditional RNA, amall cajal body-specific RNA, macro long non-protein-coding RNA, long intergenic non-coding RNA, piwi-interacting RNA, small interfering RNA, and ribozymes.

10. The method of claim 1, wherein said one or more template ribonucleic acid molecules comprise an artificially fragmented ribonucleic acid template, a naturally fragmented ribonucleic acid template, or a combination thereof.

11. The method of claim 1, wherein using said R2 reverse transcription enzyme to perform the amplification reaction yields the plurality of complementary deoxyribonucleic acid molecules in a time period of less than three hours.

12. The method of claim 1, wherein said R2 reverse transcription enzyme comprises SEQ ID NO: 49.

13. The method of claim 11, wherein said R2 reverse transcription enzyme comprises the amino acid sequence of SEQ ID NO: 50.

14. The method of claim 1, wherein said R2 reverse transcription enzyme comprises the amino acid sequence of SEQ ID NO: 51.

15. The method of claim 1, wherein said R2 reverse transcription enzyme comprises the amino acid sequence of SEQ ID NO: 53.

16. The method of claim 1, wherein said R2 reverse transcription enzyme comprises the amino acid sequence of SEQ ID NO: 54.

17. The method of claim 1, wherein said R2 reverse transcription enzyme comprises the amino acid sequence of SEQ ID NO: 55.

18. The method of claim 1, wherein said R2 reverse transcription enzyme comprises the amino acid sequence of SEQ ID NO: 56.

19. The method of claim 1, wherein said R2 reverse transcription enzyme comprises the amino acid sequence of SEQ ID NO: 57.

20. The method of claim 1, wherein said R2 reverse transcription enzyme comprises the amino acid sequence of SEQ ID NO: 58.

21. The method of claim 1, wherein said R2 reverse transcription enzyme comprises the amino acid sequence of SEQ ID NO: 59.

22. The method of claim 1, wherein said R2 reverse transcription enzyme comprises the amino acid sequence of SEQ ID NO: 60.

23. The method of claim 1, wherein said R2 reverse transcription enzyme comprises the amino acid sequence of SEQ ID NO: 61.

24. The method of claim 1, wherein said R2 reverse transcription enzyme comprises the amino acid sequence of SEQ ID NO: 62.

25. The method of claim 1, wherein said R2 reverse transcription enzyme comprises the amino acid sequence of SEQ ID NO: 63.

26. The method of claim 1, wherein said R2 reverse transcription enzyme comprises the amino acid sequence of SEQ ID NO: 64.

27. The method of claim 1, wherein said R2 reverse transcription enzyme comprises the amino acid sequence of SEQ ID NO: 65.

28. The method of claim 1, wherein said R2 reverse transcription enzyme comprises the amino acid sequence of SEQ ID NO: 66.

29. The method of claim 1, wherein said R2 reverse transcription enzyme comprises the amino acid sequence of SEQ ID NO: 67.

* * * * *